United States Patent 11,479,782 (ALFALFA WITH REDUCED LIGNIN COMPOSITION) - sequence listing, part 4

SEQ ID NO: 19553 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19554 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19555 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19556 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19557 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19558 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19559 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19560 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctcccaacaactacccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19561 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19562 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19563 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19564 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19565 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 19566 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19567 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttattgtttggctactgttgctaa

SEQ ID NO: 19568 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19569 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19570 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 19571 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19572 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19573 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19574 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcgcctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19575 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19576 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19577 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19578 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19579 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 19580 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19581 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatccagagactttatggtttggctactgttgctaa

SEQ ID NO: 19582 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19583 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19584 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19585 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19586 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19587 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 19588 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19589 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctaaagctggacctggtgctcaaatttcacctattgaaattgcttctcagcttccaacaactaaccctgatgcaccagtcatgttggaccgaatgttgcgtctcttggcttgttgcaatatcctcacttgttctgttcgtactcaacaagatggaaaggttcagagactttatggtttggctactgttgctaa

SEQ ID NO: 19590 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19591 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19592 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 19593 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19594 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19595 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggtgctcaaatttcacctattgaaattgcttctcagctcccaacaactaaccctgatgcaccggttatgttggaccgaatgttgcgtctcttggcttgttacaatatcctcacttgttcagttcgtactcaacaagatggaaagattcagagactttatggtttggctactgttgctaa

SEQ ID NO: 19596 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19597 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctatttaaattgcttctcagctcccaacaactaaccctgatgcaccagttatgttggaccgaatgttgcgtctcttggcttgttacaatatcctcacttgttcagttcgtactcaacaagatggaaaagttcagagactttatagtttggctactgttgctaa

SEQ ID NO: 19598 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19599 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19600 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19601 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 19602 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19603 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatccgcacttgttcaggtcgtactcaacaagatggaaaggttcagagactttatggtttggctactgttgctaa

SEQ ID NO: 19604 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19605 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19606 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19607 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19608 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19609 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19610 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19611 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19612 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19613 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcctctcttggcttgttacaatatcctcacttgttcagttcgtactcaacaagatggaaaagttcagagactttatggtttggctactgtggctaa

SEQ ID NO: 19614 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 19615 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaagttcacctgttcaaattgcttctcagctcccaacaactaaccctgatgcaccagttatgttggaccgaatgttgcgtctcttggcttgttacaatatcctcacttgtgaagttcgtactcaacaagatggaaagattcagagactttatggtttggctactggtgctaa

SEQ ID NO: 19616 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 19617 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaacattaaagctggacctgttgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19618 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19619 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaacattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19620 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttataatatcctcacttgttcagttcgtactcaacaagatggaaaagttcagagactttatggtttggctactgttgctaa

SEQ ID NO: 19621 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19622 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19623 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19624 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19625 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 19626 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19627 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19628 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaagattcagagactttatggtttggctactgtgctaa

SEQ ID NO: 19629 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19630 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19631 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 19632 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19633 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19634 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19635 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19636 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19637 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19638 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19639 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctggtgctcaaatttcacctattgaaattgcttctcagctcccaacaactaaccctgatgcaccagttatgttggaccgaatgttgcgtctcttggctagttacaatatcctcacttgttcagttcgtactcaacaagatggaaagattcagagactttatggtttggatactgttgctaa

SEQ ID NO: 19640 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19641 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19642 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19643 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19644 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19645 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctaaagctggacctggtgctcaaatttcacctattgaaattgcttctcagctcccaacaactaaccctgatgcaccagttatgttggaccgaatgttgcgtctctgggcttgttacaatatcctcacttgttcagttcgtactcaacaagatggaaagatgcagagactttatggtttgcactgttgctaa

SEQ ID NO: 19646 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19647 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattccgactgagcctttcgttttatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19648 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 19649 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19650 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19651 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19652 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaatgctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19653 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 19654 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19655 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19656 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19657 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19658 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19659 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagttggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19660 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagttatgttggaccgaatgttgcgtctcttggcttggtacaatatcctcacttgttcagttcgtactcaacaagatggaaagattcagagactttatggtttggctactgttgctaa

SEQ ID NO: 19661 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19662 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatccacttgttcagttcgtactcaacaagatggaaaggttcagagactttatggtttggctactgttgctaa

SEQ ID NO: 19663 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19664 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19665 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19666 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19667 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19668 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19669 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19670 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19671 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19672 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19673 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19674 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 19675 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19676 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 19677 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 19678 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19679 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 19680 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgtgggaccgaatgttgcgtctcttggcttgttacaatatcctcacttgttcagttcgtactcaacaagatggaaaggttcagagacgttatggtttggctcctggtgctaa

SEQ ID NO: 19681 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19682 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19683 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 19684 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctctcttgttcagtgcgtactcaacaagatggaaagattcagagactttatggtttgggctactgttgctaa

SEQ ID NO: 19685 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19686 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19687 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 19688 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19689 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 19690 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19691 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctagtgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19692 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgttaaagctggacctggtgctcaaatttcacctattgaaatttcttctcaactaccaacaactaaccctgatgcaccagttatgttggaccgaatgttgcgtcttctggcttgttacaatatcctcacttgttcagttcgtactcaacaagatggaaaggttcagagactttatggtttggctactgttgctaa

SEQ ID NO: 19693 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19694 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19695 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19696 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19697 - DNA, 478 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgggcctggcacagcaccggcaacagccgctggaccgtctccagcgcctgcttgccaccgccattgctggcgatggccaccacctgctggggggtcaagccgtgggcctggcacagcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19698 - DNA, 478 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgggcctggcacagcaccggcaacagccgctggaccgtctccagcgcctgcttgccaccgccattgctggcgatggccaccacctgctggggggtcaagccgtgggcctggcacagcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19699 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19700 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19701 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19702 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatggacctggtgctcaaatttcacctattgaaattgctcctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19703 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggttctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 19704 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19705 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19706 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19707 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19708 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgttaa

SEQ ID NO: 19709 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19710 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19711 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgggtactgttgctaa

SEQ ID NO: 19712 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19713 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19714 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19715 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19716 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19717 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19718 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19719 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19720 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19721 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19722 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19723 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19724 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19725 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19726 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19727 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19728 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19729 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19730 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19731 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19732 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19733 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19734 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 19735 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctaccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19736 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19737 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 19738 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19739 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19740 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaagttcagagactttatggtttggctactgttgctaa

SEQ ID NO: 19741 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19742 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19743 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 19744 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19745 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19746 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19747 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctccagcgccggcctgccgccgccattgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19748 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19749 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19750 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 19751 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19752 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19753 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19754 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaagctggacctggtgctcaaatttcacctattgaaattgcttctcagatcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19755 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19756 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttctcctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19757 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19758 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19759 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19760 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggtccagagactttatggtttggctgctgttgctaa

SEQ ID NO: 19761 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctacagttgctaa

SEQ ID NO: 19762 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19763 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 19764 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 19765 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19766 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19767 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19768 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcatctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19769 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19770 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 19771 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacgactaaccctgatgcaccaggcatgttggaccgaatgttgcgtcgcttggcttgttacaatatcctcacttgttctgttcgtactgaacaagatggaaaggttcagaggctttatgggttggcgacggggggtaa

SEQ ID NO: 19772 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19773 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19774 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 19775 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19776 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaagttcagagactttatggtttggctactggtgctaa

SEQ ID NO: 19777 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgtgctaa

SEQ ID NO: 19778 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgggtactgttgctaa

SEQ ID NO: 19779 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaagattcagagactttatggtttggctactgttgctaa

SEQ ID NO: 19780 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19781 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19782 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19783 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19784 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 19785 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19786 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 19787 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 19788 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 19789 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 19790 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagtaatgttggaccgaatgttgcgtctcttggcttgttacaatatcctcacttgttcagttcgtactcaacaagatggaaagattcagagactttatggtttggctactgttgctaa

SEQ ID NO: 19791 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19792 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19793 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctgatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19794 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19795 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19796 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19797 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19798 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19799 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19800 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19801 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19802 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19803 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19804 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19805 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19806 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19807 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19808 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19809 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19810 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19811 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19812 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19813 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19814 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatccttgaccaggctgtcaaatttcctctattgtaattgcttgtcattgctcatcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19815 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19816 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19817 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19818 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19819 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19820 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19821 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctgttgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 19822 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19823 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19824 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19825 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19826 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 19827 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19828 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgtgctaa

SEQ ID NO: 19829 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19830 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19831 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19832 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19833 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgtgacgctcaagtcagaggtaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19834 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgtgacgctcaagtcagaggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19835 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19836 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgtaaaaaggccgcgttgctggcgtttttccataggctccctctggcaacgctgcgatcatgtcctgatacttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19837 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgtaaaaaggccgcgttgctggcgtttttccataggctccctctggcaacgctgcgatcatgtcctgatacttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaaaatggaaaggttcagagactttatggtttggctactgttgctaa

SEQ ID NO: 19838 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19839 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19840 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19841 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 19842 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19843 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctgttcaaattgcttctcagcttccaacaactaaccctgatgcaccagttatgttggaccgaatgttgcgtctcttggcttgttacaatatcctcacttgttcagttcgtactcaaccagatggaaagattcagagactttatggtttggctactgttgctaa

SEQ ID NO: 19844 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19845 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19846 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19847 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19848 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19849 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19850 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19851 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggcgatggccaccacctgctccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19852 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggagacggtccagcggctgttgccggtgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19853 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggagacggtccagcggctgttgccggtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19854 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19855 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgtacagttcgtactcaacaagatggaaaggttcagagactttatggtttggctactgttgctaa

SEQ ID NO: 19856 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19857 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19858 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19859 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19860 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19861 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagctaccaacaactaaccctgatgcaccagttatgttggaccgaatgttgcgtctcttggcttgttacaatatcctcactagttcagttcgtactcaacaagatggaaaggttcagagactttatggtttggctactgttgctaa

SEQ ID NO: 19862 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgcccacggcttgaccccggagcaggtggtggccatcgccagctaaagttggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19863 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgcccacggcttgaccccggagcaggtggtggccatcgccagctaaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19864 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19865 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19866 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgccaccgccattgctggcgatggccaccacctgctggggggtcaagccgtgggcctggcacagcaccggcaacagccgctggacctaaagctggacctggtgctcaaatttcacctattgaaattgcttctcaactaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19867 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgaccgagttcaagttcctgttcgtgtccggcctaaagctggacctggtgctcaaatttcacctattgaaattgcttctcagctcccaacaactaatcctgatgcaccagttatgttggaccgaatgttgtgtctcttggcttgttacaatatcctcacttgctcagttcgtattcaacaagatggaaagattcagagactttatggtttggctactgttgctaa

SEQ ID NO: 19868 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19869 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19870 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19871 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19872 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19873 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19874 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19875 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19876 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19877 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 19878 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19879 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 19880 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgagtgttgcgtctcttggcttgttacaatatcctcacttgttcagttcgtactcaacaagatggaaaagttcagagactttatggtttggctactgttgctaa

SEQ ID NO: 19881 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19882 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19883 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19884 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19885 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgatcaaatttcacctattgaaattgcttctcagctcccaacaactaaccctgatgcaccagttatattggacccaatgttgcgtctcttggcttgttacaatatcctcacatgttcagttcgtcctcaacaagatggaaagattcagagactttatggtttggctactgttggtaa

SEQ ID NO: 19886 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19887 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 19888 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19889 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19890 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggccatcgccagcaatggcggcggcaggccggcgctggagagcattgttgcccagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19891 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19892 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 19893 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19894 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19895 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19896 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 19897 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19898 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19899 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19900 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19901 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19902 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaaggttcagagactgtatggtttggctactgttgctaa

SEQ ID NO: 19903 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19904 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19905 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19906 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 19907 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19908 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19909 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19910 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19911 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19912 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19913 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19914 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaacgttgcgtctcttggcttgttacaatatcctcacttgttcagttcgtactcaacaagatggaaaggttcagagactttatggtttggctactgttgctaa

SEQ ID NO: 19915 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggacctaatgttgcgtctcttggcttgttacaatatcctcacttgtgcagttcgtactcaacaagatggaaaggttcagagactttatggtttggctactgttgctaa

SEQ ID NO: 19916 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19917 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 19918 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatcgttgcgttaagccaacacccggcagcgtttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19919 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatcggccaacgcgcggggagaggcggtctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19920 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatcggccaacgcgcggggagaggcggtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19921 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19922 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19923 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19924 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19925 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatagctggacctggtgctcaaatttcacctattgaaattgcttctcagctaccaacaactaaccctgatgcaccagttatgttggaccgaatgttgcgtctcttggcttgttacaatatcctcacttggtcagttcgtactcaacaagatggaaaggttcagagactttatggtttggctactgttgct

SEQ ID NO: 19926 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19927 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19928 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19929 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 19930 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacatgatggaaagattcagagactttatggtttggctactgttgctaa

SEQ ID NO: 19931 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19932 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttgggttgttacaatatcctcacttgttcagttcgtactcaacaagatggaaagattcagagactttatggtttggctactgttgctaa

SEQ ID NO: 19933 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19934 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19935 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19936 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19937 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19938 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19939 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19940 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtcgcgtggcttgttacaatatcctcacttgttcagttcgtactcaacaagatggaaagattcagagactttatggtttggctactgttgctaa

SEQ ID NO: 19941 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtacgcaacaagatggaaaggttcagagactttatggtatggatactgttgctaa

SEQ ID NO: 19942 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19943 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 19944 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 19945 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19946 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcaattcgtactcaacaagatggaaaggttcagagactttatggtttggctactgttgctaa

SEQ ID NO: 19947 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 19948 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 19949 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19950 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaggtcctaaaatttcacctattaaaattgcttctcagctcccaacaactaaccctgatgcaccagttacgttggaccgaatgtggcgtctctgggcttgttacaatatcctcacttgttcagttcgtactcaacaagatggaaaggttcagagactttatggtttggctactgttgctaa

SEQ ID NO: 19951 - DNA, 466 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaggcgctggagacggtgcaggcgctgttgccggtgctgtgccaggcccacggcttgaccccggagcaggtggtggccatcgccagcaatattggtggcaagcaggcgctggacgacctggtgctcaaatttcacctattgaaattgcttcgcagctaccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19952 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19953 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19954 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgattgttgcgtctcttggcgtgttacaatatcctcacttgttctgttcgtactcaacaagatggaaaggttcagagactttatggtttgctactgttactaa

SEQ ID NO: 19955 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19956 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19957 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaatgattcagagactttatggtttggctactgttgctaa

SEQ ID NO: 19958 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19959 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19960 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19961 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19962 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19963 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19964 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19965 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19966 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19967 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19968 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggggggtcaagccgtgggcctggcacagcaccggcaacagccgctggaccgtctccagcgcctgctgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19969 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggggggtcaagccgtgggcctggcacagcaccggcaacagccgctggaccgtctccagcgcctgaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19970 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19971 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgtttctcagctaccaacaactatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19972 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 19973 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19974 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19975 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19976 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19977 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19978 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19979 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19980 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19981 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19982 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19983 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19984 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19985 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 19986 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacggtccagcggctgttgccggtgctgtgccaggcccacggcttgaccccccagcaggtggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19987 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19988 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19989 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19990 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 19991 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19992 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19993 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaataaagctgtacctggtgctcaaatttcacctattgaaattgcttctcagctaccaacaactaaccctgatgcaccagatatgttggaccgaatgttgcgtctcttggcttgttacaatatcctcacttgttcagttcgtactcaacaagatggaaaggttcagagactttatggtttggctactgttgctaa

SEQ ID NO: 19994 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaataaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19995 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcgcctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19996 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19997 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19998 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatccacacttgttcagttcgtactcaacaagatggaaagattcagagactttatggtttggctactgttgctaa

SEQ ID NO: 19999 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20000 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20001 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20002 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20003 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20004 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 20005 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 20006 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 20007 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20008 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20009 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20010 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 20011 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20012 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20013 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctgctgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 20014 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctgatgctcaaatttcgcctattgaaattgcttctcagctaccaacaactaaccctgatgcaccagttatgttggaccgaatgttgcgtctcttggcttgttacaatatcttcacttgttcagttcgtactcaacaagatggaaagattcagagactttatggtttggctactgttgctaa

SEQ ID NO: 20015 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20016 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20017 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20018 - DNA, 385 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaacagataaaacgaaaggctcagctaaagctggacctggtgctcaaatttcacctattgaaattgcttctcagctaccaacaactatccctgatgcaccagttatgttggaccgaatgttgcgtctcttggcttgttacaatatcctcacttgttcagttcgtactcaacaagatggaaagattcagagactttatggtttggctactgtagctaa

SEQ ID NO: 20019 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctgttgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20020 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20021 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20022 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20023 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttgacttgttacaatatcctcacttgttcagttcgtactcaacaagatggaaaggttcagagactttatggtttggctactgttgctaa

SEQ ID NO: 20024 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20025 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20026 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20027 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20028 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaatcaacaagatggaaagattcagagactttatggtttgctactgttgctaa

SEQ ID NO: 20029 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20030 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgactcttggcttgttacaatatcctcacttgttcagttcgtactcaacaagagggaaaggttcagagactttatggtttgggtactgttgctaa

SEQ ID NO: 20031 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20032 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20033 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20034 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20035 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactaaacaagatggaaaggttcagagactttatggtttggatactgttgctaa

SEQ ID NO: 20036 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20037 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcctctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20038 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagttatgttggaccgaatgtggcgtctcttggcttgttacaatatcctcactttttcagttcgtactcaacaagatggaaaagttcagagactttatcgtttggctactgttgctaa

SEQ ID NO: 20039 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20040 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20041 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20042 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20043 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20044 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20045 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20046 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtcctcaaatttcacctattgaaattgcttctcagctaccaacaactaaccctgatgcaccagttatgttggaccgattgttgcgtctcttggcttgttacaatatcctcacttgttcagttcgtactcaacaagatggaaaggttcagagactttatggtttggctactgttgctaa

SEQ ID NO: 20047 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20048 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20049 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20050 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20051 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20052 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20053 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20054 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20055 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20056 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20057 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20058 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20059 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20060 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20061 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20062 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20063 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20064 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgcacaaatttcacctattgaaattgcttctcagctaccaacaactaaccctgatgcaccagttatgttggaccgaatattgaatatcttggcttgttacaatatcctcccttgttcggttcgtactcaacaagatggaaaggttcagagactttatggtttggctactggtgctaa

SEQ ID NO: 20065 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20066 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20067 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatacaatatcctcacttgttcagttcgtactcaacaagatggaaaagttcagagactttatggtttggctactgttgctaa

SEQ ID NO: 20068 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20069 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20070 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20071 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20072 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20073 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20074 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20075 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20076 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20077 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctcccaacaactaaccctgatgcaccagtcatgttgtaccgaatgttgcgtctcttggcttgttacaatatcctcacttgttctgttcgtactcaacaagatggaaaggttcagagcctttatggtttggctactgttgctaa

SEQ ID NO: 20078 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20079 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20080 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20081 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 20082 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20083 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagatggacctggtgctcaaatttcacctgttcaaattgcttctcagcttccaacaactaaccctgatgcaccagtcatgttggaccgaatgttgcgtctcttggcttgttccaatatcctcacttgttctgttcgtactcaacaagatggaaaggttcagagcctttatggtttggctactgttgctaa

SEQ ID NO: 20084 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagcttgaccttgtgatcaaatttcacctattgaaattgcttctcagctcccaacaactaaccctgatgcaccagttatgttggaacgaatgttgcgtctattggcttgttacaatatcctcacttgttcagttcgtactcaacaagatggaaagattcagagactgtatggtttggctactgttgctaa

SEQ ID NO: 20085 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagcttgacctggtgctcaaatttcacctattgaaattgattctcagctaccaacaactaaccctaattcaccagttatcttgtaccgaatattccgtctcttgtcttgttacaatatcctcacttgttcacttcttactcaacaatatttaaatattcacacactttattgtttagctactattcctaa

SEQ ID NO: 20086 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20087 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20088 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcgtgtttgaccgaatgttgcgtctctgggcttgttacaagatcctcgcttgttctgttcgtactcaacaagatggaaaggttcggagtctttatggtttggctactgttgctaa

SEQ ID NO: 20089 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20090 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20091 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 20092 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20093 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 20094 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20095 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20096 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagcttccaacaactaaccctgatggaccagttatgttggaccgaatgttgcgtctcttggcttgttacaatatcctcacttgttcagttcgtactcaacaagatggaaaggttcagagactttatggtttggctactgttgctaa

SEQ ID NO: 20097 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20098 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20099 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 20100 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20101 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20102 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 20103 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20104 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggcactgttgctaa

SEQ ID NO: 20105 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20106 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 20107 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaagattcagagactttatggtttggctactgttgctaa

SEQ ID NO: 20108 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 20109 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 20110 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaagttcagagactttatggtttggctactgttgctaa

SEQ ID NO: 20111 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgataa

SEQ ID NO: 20112 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 20113 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcttactcaacaagatggaaagattcagagactttatggtttggctactgttgctaa

SEQ ID NO: 20114 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaagattcagagactttatggtttggctactgttgctaa

SEQ ID NO: 20115 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20116 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20117 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgatttggctactgttgctaa

SEQ ID NO: 20118 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20119 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20120 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 20121 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 20122 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 20123 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 20124 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 20125 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 20126 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 20127 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 20128 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 20129 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 20130 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaacttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20131 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggaccaggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20132 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20133 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20134 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20135 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20136 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20137 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20138 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20139 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 20140 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgcta

SEQ ID NO: 20141 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20142 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagctaccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 20143 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20144 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20145 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20146 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20147 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20148 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20149 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaagtttgcttcacttggcttgttacaatatcctcacttgttcagttggtactcaacaagatggaaaagttcagagactttatggtttggctactgttgctaa

SEQ ID NO: 20150 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20151 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 20152 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtcccttggcttgttacaatatcctcacttgttcagttcgtactcaacaagatggaaaggttcagagcctttatggtttggctactgttgctaa

SEQ ID NO: 20153 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgatgcgtctcttggcttgttacaatatcctcacttgttcagttcgtactcaacaagatggaaagattcagagactttatggtttggctactgttgctaa

SEQ ID NO: 20154 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctagtgttgctaa

SEQ ID NO: 20155 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 20156 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcatgttacaatatcctcacttgttcagttcgtactcaacaagatggaaaagttcagagactttatggtttggctactgttgctaa

SEQ ID NO: 20157 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20158 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20159 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20160 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20161 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20162 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 20163 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactattgctaa

SEQ ID NO: 20164 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20165 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaacactgatgcaccagttatgttggatcgaatgttgcgtctcttggcttgttacaatatcctccattgttcagttcgtcctcaacaagatggaaagattcagagactttatggtttggctactgttgctaa

SEQ ID NO: 20166 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcgcctattgaaattgcttctcagctcccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 20167 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20168 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20169 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20170 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20171 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20172 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20173 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagcaagcaggcgctggagacggtccagcggctgttgccggtgctgtgccaggcccacggcttgctccagctggacctggtggtcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20174 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagcaagcaggcgctggagacggtccagcggctgttgccggtgctgtgccaggcccacggcttgcccacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20175 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20176 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaatttcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20177 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20178 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20179 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20180 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20181 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20182 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20183 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 20184 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20185 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacctggtgctcaaatttcacctgttcaaattgcttctcagctaccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 20186 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20187 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20188 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacttgctaa

SEQ ID NO: 20189 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20190 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20191 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacataaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 20192 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20193 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20194 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20195 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20196 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20197 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20198 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20199 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20200 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20201 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20202 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20203 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgtcggaccgaatgttgcgtctcttggcttgttacaatatcctcacttgttcagttcgtactcaacaagatggaaaagttcagagactttatggtttggctactgttgctaa

SEQ ID NO: 20204 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20205 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20206 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20207 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20208 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20209 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20210 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20211 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20212 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagatactttatggtttggctactgttgctaa

SEQ ID NO: 20213 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 20214 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20215 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgtgacaatatcctcacttgtgctgttcgtactcaacaagatggaaaggttcagagactttatggtttggctactgttgctaa

SEQ ID NO: 20216 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20217 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20218 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20219 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 20220 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20221 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20222 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20223 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20224 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 20225 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20226 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20227 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20228 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20229 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20230 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20231 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20232 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20233 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttcggctactgttgctaa

SEQ ID NO: 20234 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 20235 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20236 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 20237 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20238 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20239 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20240 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatggtgcgtctcttggcttgttacaatatcctcacttgttcagttcgtactcaacaagatggaaaggttcagagactttatggtttggctactgttgctaa

SEQ ID NO: 20241 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20242 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20243 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20244 - DNA, 304 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 20245 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20246 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20247 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20248 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20249 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgatttggctactgttgctaa

SEQ ID NO: 20250 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20251 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20252 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20253 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20254 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgttttggctactgttgctaa

SEQ ID NO: 20255 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20256 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20257 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20258 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20259 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20260 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20261 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 20262 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20263 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20264 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20265 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20266 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20267 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttccaatatcctcacttgttcagttcgtactcaacaagatggaaaagttcagagactttatggtttggctactgttgctaa

SEQ ID NO: 20268 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20269 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaaaagatggaaagattcagagactttatggtttggctactgttgctaa

SEQ ID NO: 20270 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20271 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20272 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 20273 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctagtgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20274 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20275 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20276 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20277 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20278 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20279 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20280 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20281 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggttgggctactgttgctaa

SEQ ID NO: 20282 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20283 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20284 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatttcctcacttgttcagttcgtactcaacaagatggaaaggttcagagactttatggtttggctagttgctaa

SEQ ID NO: 20285 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 20286 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20287 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaattttgcgtctcttgacttattacaatatcctcacttgttctgttcgtactcaacaatatggaaagtttcagagactttatggtttggctactgtttctaa

SEQ ID NO: 20288 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20289 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20290 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20291 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20292 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcgtctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20293 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctgcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 20294 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20295 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20296 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20297 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20298 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20299 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 20300 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20301 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaagattcagagacgttatggtttggctactgttgctaa

SEQ ID NO: 20302 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20303 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20304 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 20305 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20306 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20307 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctcagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20308 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctcagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20309 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctcagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20310 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20311 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20312 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20313 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20314 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20315 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20316 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaagattcagagactttatggtttggctactgttgctaa

SEQ ID NO: 20317 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20318 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20319 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcaattcgtactcaacaagatggaaagattcagagactttatggtttggctactgttgctaa

SEQ ID NO: 20320 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20321 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20322 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20323 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20324 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20325 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20326 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 20327 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcctagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20328 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20329 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcaagctggacctggtgctcaaatttcacctattgaaattgcttctcagctaccaacaactaaccctgatgcaccagttatgttggaccgaatgttgcgtctcttgtcttgttacaatatcctcacttgttcagttcgtactcaacaagatggaaagattcagagactttatggtttggctactgttgctaa

SEQ ID NO: 20330 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20331 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20332 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20333 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20334 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 20335 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20336 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20337 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20338 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20339 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20340 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20341 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20342 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20343 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 20344 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20345 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatatcttagaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 20346 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20347 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20348 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20349 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20350 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggcttggctactgttgctaa

SEQ ID NO: 20351 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20352 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20353 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgataaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaagttcagagactttatggtttggctactgttgctaa

SEQ ID NO: 20354 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20355 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20356 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20357 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20358 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20359 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20360 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20361 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttaaagctggacctggtgctcaaatttcacctgttcaaattgcttctcagcttccaacaactaaccctgatgcaccagtcatgttggaccgaatgttgcatctcttggcttgttacaatatcctcacttgttcagttcgtactcaacaagatggaaaggttcagagactttatggtttggctactgttgctaa

SEQ ID NO: 20362 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20363 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20364 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttaaagctggacccggtgctcaaatttcacctgttcaaattgcttctcagcttccaacaactaaccctgatgcaccagtcatgttggacctaatgttcagtcgattgggttgttacaatatcctcacttgttcagttcgtactcaacaagatggaaagattcagagactttatggtttggctactgttgataa

SEQ ID NO: 20365 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20366 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaagttcagagactttatggtttggctactgttgctaa

SEQ ID NO: 20367 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20368 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20369 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20370 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20371 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20372 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20373 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20374 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20375 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacctgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20376 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20377 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20378 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20379 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20380 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20381 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20382 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20383 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20384 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 20385 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctcgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20386 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctcgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20387 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctcgaacttgatctcttagaaaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 20388 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcctgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20389 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcatgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtaa

SEQ ID NO: 20390 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagcccttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20391 - DNA, 445 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcacttgaaggcggtaatacggttatccacagaatcaggggataacgcaggaaagaacatgtgagcaaaaggccagcaaaaggccaggaaccgtaaaaaggccgcgttgctggcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgca

SEQ ID NO: 20392 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20393 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20394 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20395 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20396 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20397 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20398 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20399 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaaacagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20400 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20401 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20402 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20403 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20404 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaattaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 20405 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20406 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20407 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20408 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcattgtcctactcaggagagcgttcaccgacaaacaacagataaaacgaaaggcccagtcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20409 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20410 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20411 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20412 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 20413 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20414 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20415 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20416 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20417 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20418 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20419 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20420 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20421 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20422 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20423 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttagaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20424 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttagaaatcagctcttgaacttgatctcttagaaatcactggacctggtgctcaaatttcacctattgaaattgcttctcagctcccaacaactgaccctgatgcaccagttatgttggaccgaatgttgcgtctcttggattgttacaatatcctcacttgttcagttcgtactcaacaagatggaaaggttcagagactttatggtttggctactgttgataa

SEQ ID NO: 20425 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20426 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20427 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattgtgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20428 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20429 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20430 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20431 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20432 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20433 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaataaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20434 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20435 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaaagctggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 20436 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagatagaaaggttaagagccttgatggtttggctactgttgctaa

SEQ ID NO: 20437 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20438 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20439 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20440 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattatgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20441 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatcttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20442 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatcttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20443 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20444 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20445 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20446 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20447 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20448 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctcccaacaactaaccctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 20449 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtcgctaa

SEQ ID NO: 20450 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20451 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20452 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20453 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctggtgcacaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20454 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgataaagctggacctagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20455 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgagtttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcggagactttatggtttggctactgttgctaa

SEQ ID NO: 20456 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgactttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20457 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgactttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 20458 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgactttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20459 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgactttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20460 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaatttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtgcagagactttatggtttggactgttgctaa

SEQ ID NO: 20461 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20462 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20463 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20464 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20465 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 20466 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20467 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20468 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20469 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20470 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20471 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20472 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttgaaatcagctcttgaacttgatctcttagaaatctaaagctggacctggtgctcaaatttcacctattgaaattgcttctcagctaccaacaattaaccctgatgcaccagttatgttgtaccgaatgttgcgtctcttggcttgttacaatatcctaacttgttaagttcgtactcaacaagatggaaaagttcagagcctttatggtttggctactgttgctaa

SEQ ID NO: 20473 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20474 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20475 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20476 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttaaaatcagctcttgaacttgatctcttagaaagctaaagctgcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgtttctaa

SEQ ID NO: 20477 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20478 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20479 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 20480 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccataaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20481 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccacgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20482 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccacgattttgaaatcagctcttgaacttgatctcttagaaatcactaaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaaggttcagagactttatggtttggctactgttgctaa

SEQ ID NO: 20483 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccaagattttgaaattgcttctcagctaccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 20484 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccaagattttgaaatcagctcttgaacttgatctcttagaaattaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20485 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccaagattttgaaatcagctcttgaacttgatctcttagaaatcattgccggtgctgtgccaggcccacggcttgaccccggagcaggtggtggccatcgccatccacgatggcggcaagcaggcgctggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20486 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 20487 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20488 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20489 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatgtcctcacttgttcagttcgtactcaacaagatggaaaagttcagagactttatggtttggctactgttgctaa

SEQ ID NO: 20490 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20491 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20492 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaattaaagctggacctggtgctcaaatttcacctattgaaattgctgctcagctaccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 20493 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20494 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20495 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20496 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatcaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 20497 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatccttacttgttcagttcgtactcaacaagatggaaaggttcagagactttatggtttggctactgttgctaa

SEQ ID NO: 20498 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20499 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaaagctggacctggtgctcaaatatcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20500 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20501 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaaattgatctcttagaaattgtgttcaaatttcacctattgaaattgcttctcagctcccaacaactaaccctgatgcaccagttattttggaccgaatgtttcgtctcttgacttattacaatatcctcacttgttcatttcctactcaacaatatataaacgttcagagactttatggtttcgctactgttcctaa

SEQ ID NO: 20502 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaataagctcttgaacttgatctcttagaactaaagctggacctggtgctcaaatttcacctattgaaattgcttctcagctcccaacaactaaccctgatgcaccagttatgtttcaccgaatctttcgtctcttggcttgttacaatatcctcactttttcagttcctactcaacaagattgaaagattcacatactttatggtttgactactgttgctaa

SEQ ID NO: 20503 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20504 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20505 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20506 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20507 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactggtgctaa

SEQ ID NO: 20508 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20509 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20510 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20511 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20512 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 20513 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaactaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggatactgttgctaa

SEQ ID NO: 20514 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagatcttgaacttgatctattagaaataaagctgcatctgatgctcaaatttcacctattgaaatttattctcagctaccaacaactaaccctgatacaccatttatgttttacctaatttttcttctctttactttttacaatatcctcacttattcatttcgtactcaacaatatttaaaagttcagagactttatgatttacctacttttactaa

SEQ ID NO: 20515 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 20516 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcaaatgattttgaaataagctcttgaacttgatctcttagaaataatctgtacctgctgctcaaatttcacctattgaaattacttctcagctacaaacaactaaccctgatgcaccagttatcttttacctaatatttcatctcttgtctttttacaatatcctcacttattcatttcgtactcaacaatatataaaatttcacatactttattattttcctactgttgctaa

SEQ ID NO: 20517 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttaccatgattttgaaatcagctcttgaacttgatctcttagaaattctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 20518 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttaccatgattttgaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20519 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttaccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20520 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttaccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20521 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttaccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20522 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20523 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20524 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20525 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20526 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttaaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20527 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctccccatgatcttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20528 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20529 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctacccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20530 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcctcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20531 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcctcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20532 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcctcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20533 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcctcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20534 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttattcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20535 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttattcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20536 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttatgttggaccgaatgttgcgtctcttggcttgttacaatatcctcacttgttctgttcgtactcaacaagatggaaaggttcagagactttatggtttggctactgttgctaa

SEQ ID NO: 20537 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttatgttggaccgaatgttgcgtctcttggcttgttacaatatcctcacttgttcagttcgtactcaacaagatggaaaggttcagagactttatggtttggctactgttgctaa

SEQ ID NO: 20538 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttatgttggaccgaatgttgcgtctcttggcttgttacaatatcctcacttgttcagttcgtactcaacaagatggaaagattcagagactttatggtttggctactgttgctaa

SEQ ID NO: 20539 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttatgttggaccgaatgttgcgtctcttggcttgttacaatatcctcacttgttcagttcgtactcaacaagatggaaaagttcagagactttatggtttggctactgttgctaa

SEQ ID NO: 20540 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 20541 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20542 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 20543 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20544 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20545 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20546 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20547 - DNA, 311 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 20548 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgatgctaa

SEQ ID NO: 20549 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20550 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgtcctgttcgtactcaacaagatggaaaggttcagagactttatggtttggctactgttgctaa

SEQ ID NO: 20551 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20552 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagtgcttcccatgagtttgaaatcagctctcgaacttgatctcttagaaatctaaagctggacctggtgctcaaatttcacctattgaaattgcttctcagctaccaacagctaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20553 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagtccttcccatgattttgaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaatttcagagactttatggtttggctactgttgctaa

SEQ ID NO: 20554 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagtccttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20555 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagtccttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20556 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagtccttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20557 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagtacttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20558 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcaggtcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttgacttgttacaatatcctcacttgttcagttcgtcctcaacaagatggaaaggctcagagactttatggtttggctactgttgctaa

SEQ ID NO: 20559 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20560 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20561 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagatcttcacatgattttgaaatcagctcttgaacttgatctcttagaaaagctggacctggtgctcaactttcacctattgaaattgcttctcagctaccaacaactaaccctgatgcaccagttatgttggaccgaatgttgcgtctcttggcttgttacaatatcctctcttgttcagttcgtactcaacaagatggaaagtttcagagactttatggtttggctactgttgctaa

SEQ ID NO: 20562 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcaattcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20563 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcaattcttcccatgattttgaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20564 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcaattcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcttcctcatcaatatggaaaagttcagagactttatggtttggctcctgttgctaa

SEQ ID NO: 20565 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20566 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttaagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20567 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttaagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20568 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctgcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20569 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctgcagttcttcccatgattttaaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20570 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttgaaatcagctcttgaacttgatctcttagagctggacctggtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20571 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20572 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20573 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagcctttatggtttggctactgttgctaa

SEQ ID NO: 20574 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20575 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20576 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctacagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20577 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20578 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20579 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20580 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20581 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20582 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20583 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20584 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttagaaatttacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20585 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 20586 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttagaaatcaagctggacctggtgctcaaatttcacctattgaaattgcttctcagctaccaacaactaaccctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 20587 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20588 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20589 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20590 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgacctcgtagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20591 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20592 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 20593 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20594 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20595 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20596 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20597 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20598 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcatcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20599 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgattcagttcttcccatgattttgaaatcagctcttgaacttgatctcttagaactaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20600 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgattcagttcttcccatgattttaaaatcagctcttgaacttgatctcttagctggacctggtgctcaaatttcacctgttcaaattgcttctcagcttccaacaactaaccctgatgcaccagtcatgttggaccgaatgttgcgtctcttggcttgttgcaatatcctcacttgttctgttcgtactcaacaagatggaaaggttcagagactttatggtttggctactgttgctaa

SEQ ID NO: 20601 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgattcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20602 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtccttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20603 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20604 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20605 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaaagctggacctggtgctcaaatttcacctattgaaattgcttctcatctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20606 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20607 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaaggtcttcagttcttcccatgattttgaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20608 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20609 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20610 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20611 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaactaaagctggacctggtgctcaaatttcacctattgaaatttcgtctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20612 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20613 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20614 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20615 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20616 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20617 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 20618 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 20619 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatctaaagctggacctggtgctcaaatttcacctattgaaattgcctctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 20620 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatctaaagctggaactggtgctcaaatttcacctattgaaattgcttctcagctaccaccaactaaccctgatgcaccagttatgttggtccgaatgttgcgtctcttggcttgttacaatatcctcacttgttcagttcgtcctcaacaagatggaaaggttcagagactttatggtttggctactgttgctaa

SEQ ID NO: 20621 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgggcctggcacatcaccgacaacagccgctggaccgtctccagcgcctgcttgccgctaaagctggacctggtgctcaaatttcacctattgaaattgcttctcagctaccaacaactaaccctgatgcaccagttatgttggaccgaatgttgcgtctcttggcttgtgacaatatcctcacttgttcagttcgtactcaacaagatggaaagattcagagactttatggtttggctactgttgctaa

SEQ ID NO: 20622 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20623 - DNA, 441 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcatggataacgccacggaatgatgtcgtcgtgcacaacaatggtgacttctacagcgcggagaatctcgctctctccaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20624 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20625 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcatccagcgccggcctgccgccgccattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttacggtttggctactgttgctaa

SEQ ID NO: 20626 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20627 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20628 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaaggttcagagactttatggtttggctactgttgctaa

SEQ ID NO: 20629 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20630 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20631 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20632 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 20633 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20634 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20635 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttaaagctggacccggtgctcaaatttcacctattgaaattgcttctcagctaccaacaactaaccctgatgcaccagttatgttggaccgaatgttgcgtctctaggcttgttacaatatcctcacttgttcagttcgtactcaacaagatggaaaggttcagagactttatggtttggctactgttgctaa

SEQ ID NO: 20636 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20637 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20638 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagggcctcagttcttcccatgattttgaaatcagctcttgaacttgatctcttagaaattaaagctgcacctgttgatcaaatttcacctattgaaattgcttctcagctaccaacaactaaccctgatgcaccagttatgttggaccgaatgttgcgacacgtggcttgttacaatatcctcccttgttcagttcgtactcaaccagatggaaaagttcagagactttatggtttggctactgttgcaaa

SEQ ID NO: 20639 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagagcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20640 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagagcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20641 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagagcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 20642 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagagcttcagttcctcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20643 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaactgcttcagttcttcccatgattttgaaatcagctcttgaacttgatctcttagaaatctaaagctggacctggtgctcaaatttcacctattgaaattgcttctcaacttccaacaattaaccctgatgcaccacttatgttggaccgaatgttgcgtctcttggcttgttacaatatcctcacttgttcagttcgtactcaacaagattgaaaggttcagagactttatggtttggctactgttgctaa

SEQ ID NO: 20644 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaaatgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcggctcttggcttgttacaagatcctcgcttgttcagttcgttctcagcaagatggaaagattcagagactgtatggtttggctactgttgctaa

SEQ ID NO: 20645 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20646 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagaaagtgcttcagttcttcccatgattttgaaataagctcttgaacttgatctcttagaaatctaaagctggacctggtgctcaaatttcacctattgaaattgcttctcaggtcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20647 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaccaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20648 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaccaagtgcttcagttcttcccatgattttgaaatcagctcttgaacttgatctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20649 - DNA, 236 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 20650 - DNA, 236 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20651 - DNA, 236 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20652 - DNA, 236 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20653 - DNA, 236 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20654 - DNA, 235 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatccccacttgttcagttcgtactcaacaagatggaaggttcagagactttatggtttggctactgttgctaa

SEQ ID NO: 20655 - DNA, 236 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 20656 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20657 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20658 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20659 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20660 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20661 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20662 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20663 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttaaaatcagctcttgaacttgatctcttagaaatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20664 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20665 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20666 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20667 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20668 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20669 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20670 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaaatagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20671 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattggcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20672 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20673 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20674 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20675 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20676 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatctaaagctggacctggtgctcaaatttcacctgttcaaattgcttctcagcttccaacaactacccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20677 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20678 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20679 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcaaacctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20680 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20681 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20682 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttctcatgattttgaaatcagctattgaaattgatctcttagaaatctaaagcttgacctggtgctcaaatttcacctattgaaattgcttctcagctaccaacaactaacccttatgcaccatttatgttataccgaatattccgtctctttacttgttacaatatcctcacttattcatttcctactcaacaatatttaaagtttcacacactttatggtttccctacttttcctaa

SEQ ID NO: 20683 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagtgatcaaatttcacctattgaaattgcttctcagctaccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 20684 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20685 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20686 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatagctgtacctggtgctcaaatttcacctattcaaattgcttctcagctaccaacaactaaccctgatgcaccagttatgttggacccaatatttcgtctcttcgcttcttacaatatcctcacttattcagttcttactcaacaagatataaatattcagaaactttatggtttcactactgttcctaa

SEQ ID NO: 20687 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20688 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20689 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20690 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20691 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20692 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttccaatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20693 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagtgcttcagttcttccaatgattttgaaatcagctcttgaacttgatctcttagaaatctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaagattcagagactttattgtttggctactgttgctaa

SEQ ID NO: 20694 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagggcttcagttcttcccatgattttgaaatcagctcttgaacttgatctcttagaaatttaaagctggaactggtgctcaaatttcacctattgaaattgcttctcagctcccaacaactaaccctgatgcaccagttatgttggaccgaatgttgcgtctctttgctttttacaatatcctcacttgttcagttcgtactcaaccagatggaatgattcagagtctttatggtttggctactgttgctaa

SEQ ID NO: 20695 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgaaactagcaagggcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttcgctactgttgctaa

SEQ ID NO: 20696 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20697 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcacatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20698 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20699 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctgttcaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20700 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20701 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20702 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20703 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 20704 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 20705 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctaccaacaactaaccctgatgcaccatttatgttgaaccgaatgttgcgtctcttggcttgttacaatatcctcacttgttcatttcgtactcaacaagatgcaaaatttcagagactttatggtttcgctactgttcctaa

SEQ ID NO: 20706 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 20707 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20708 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20709 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20710 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctaactgttgctaa

SEQ ID NO: 20711 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatccaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20712 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacgactagcaagtgcttcagttcttcccatgattttgaaatcagctcttaaacttgatctcttagaaattaaagctggacctggtgctcaaatttcacctattgaaattgcttctcagctaccaacaactaaccctgatgcacagttatgttggaccgaatgttgcgtctcttggcttgttacaatatcctcacttgttcagttcgtactcaacaagatggaaaggttcagagactttatggtttggctactgttgctaa

SEQ ID NO: 20713 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20714 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20715 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20716 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatctaaagctggacctggtgctcaaatttcacctattgaaattgcttctcagctcccaacaactaaccctgatgcacaagttatgttggaccgaatgttgcgtctcttggcttgttacaatatcctcacttgttcagttcgtactcaacaagatggaaaggttcagagactttatggtttggctactgttgctaa

SEQ ID NO: 20717 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcaagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20718 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20719 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcaaagctggacctggtgctcaaatctcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20720 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20721 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaattagcaagtgcttcagttatgttggaccgaatgttgcgtctcttggcttgttacaatatcctcacttgttctgttcgtactcaacaagatggaaagattcagagactttatggtttggctactgttgctaa

SEQ ID NO: 20722 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 20723 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20724 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20725 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20726 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20727 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20728 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20729 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20730 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20731 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20732 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccataaaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20733 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaggcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcttactgttgctaa

SEQ ID NO: 20734 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaggcaactagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20735 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20736 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttgaaatcagctcttgaacttgatctcttagaaatacaatatcctcacttgttcagttcgtactcaacaagatggaaaagttcagagactttatggtttggctactgttgctaa

SEQ ID NO: 20737 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20738 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20739 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20740 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20741 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20742 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20743 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 20744 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatacaatatcctcacttgttcagttcgtactcaacaagatggaaaggttcagagactttatggtttggctactgttgctaa

SEQ ID NO: 20745 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20746 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaagctggacctggtgctcaaatttcacctattgaaattgcttcccagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20747 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20748 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20749 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctctgtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20750 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20751 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaattagaaagtgcttcagttcttcccatgattttaaaatctgctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20752 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttctcatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20753 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20754 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20755 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20756 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20757 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20758 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20759 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20760 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20761 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20762 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20763 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20764 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttaaaatcagctcttgaacttgatctcttagaactaaagctggacctggtgctcaaatttcacctattgaaattgcttctcagccccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20765 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20766 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaagcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20767 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaagcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20768 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaagcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20769 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaagcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20770 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaagcaactagcaagtgcttcagttcttcccatgattttaaaatcagctcttgaacttgatctcttagaaaaagctggacctggtgctcaaatttcacctattgagattgcttctcagctaccaacaactaaccctgatgcaccagttatgttggaccgaatgttgcgtctcttggcttgttacaatatcctcacttgttcagttcgtaatcaacaagatggaaaggttcagagactttatggtttggctactgttgctaa

SEQ ID NO: 20771 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccaagcaactagcaagatcttcagttcttcacatgattttgaaatcagctcttgaacttgatctcttagacatctaaagctggaccgggtcctcaaatttcacctattgaaattgcttctcagctaccaacaactaaccctgatgcaccagttatgttggaccgaatgttgcgtctcttggcttgttacaatatcctcacttgttcagttagtactcaacaagatagaaagattcagagactttatggtttggctactgttgctaa

SEQ ID NO: 20772 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcaatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20773 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcaatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20774 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcaatgcaactagcaagtgcttcagttcttcccatgattttgaaatcagctcttgaacttgatctcttagaaatctccagcgccggcctgccgccgccattgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20775 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcaatgcaactagcaagtgcttcagttcttcccatgattttgaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20776 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcaatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20777 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcaatgcaactagcaagtgcttcagttcttcccatgattttgaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20778 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcaatgcaactagcaagtgcttcagatcttcccatgattttgaaatcagctcttgaacttgatctcttagaaatttaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 20779 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgacatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtacgcaacaagatggaaagattcagagactttatggtttggctactgttgctaa

SEQ ID NO: 20780 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgacatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20781 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgacatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20782 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgacatgcaactagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20783 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgacatgcaactagcaagtgcttcagttcttcccatgattttgaaatcagctcttgaacttgataaagctggaccttgtgctcaaatttcacctattgaaattgcttctcagctaccaccaactaaccctgatgcaccagttatgttggacccaatgttgcgtctcttggcttgttacaatatcctcacttgttcagttcgttctcaacaagatgtaaaggttcagagtctttatggtttggctactgttgctaa

SEQ ID NO: 20784 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgacatgcaactagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20785 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttccccatgcaattagcaagtgcttcagttcttcccatgattttgaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20786 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20787 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20788 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 20789 - DNA, 465 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctctcctgttccgaccctgccgcttaccggatacctgtccgcctttctcccttcgggaagcgtggcgctttctcatagctcacgctgtaggtatctcagttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20790 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20791 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20792 - DNA, 286 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaagttcagagactttatggttggctactgttgctaa

SEQ ID NO: 20793 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaattagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20794 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20795 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 20796 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20797 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20798 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20799 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20800 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20801 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20802 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20803 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttaaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20804 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 20805 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 20806 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttagccatgcaattagcaagtgctttagttcttcccatgattttaaaatcagctcttgaacttgatctcttagaaatcatctggacctggtgctcaaatttcacctgttcaaattgcttctcagcttccaacaactaaccctgatgcactagtcatgttggaccgaatgttgcgtctcttggcttgttacaatatcctcacttgttctgttcgtactcaacatgatggaaaggttcagagactttatggtttggctactgttgctaa

SEQ ID NO: 20807 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttagccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20808 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttagccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20809 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttagccatgcaactagcaagtgcttcagttcttcccatgattttaaaatcagctcttgaacttgatctcttagaaatataaagcttcacctgatgctcaaatttcacctattgaaattgcttctcagctcccaacaactaaccctgatgcaccagttatgttggaccgaatgttgcgtctcttggcttgttacaatatcctcacttgttcagttcgtcctcaacaagttggaaaggttcagagcctttatggtttggctactgttgctaa

SEQ ID NO: 20810 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttagccatgcaactagaaagtgcttcagttcttcccatgattttaaaatcagctcttgaacttgatctcttagaaataaagctggacctggtgctcaaatttcacctattgaaattgcttctcagctaccaacaactaaccctgatgcaccagttattttggaccgattgttgcgtctcttggcttgttacactatcctcacttgttcagttcttactcaacaagatggaaatgttcagagactttatggtttggctactgttgctaa

SEQ ID NO: 20811 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20812 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20813 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20814 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaattagcaagtgcttcagttcttcccatgattttaaaatcagctcttgaacttgatctcttagaaatatggacctggtgctcaaatttcacctattgaaattgcttctcatctaccaacaactaaccctgatgcaccagttatgttggaccgaatgttgcgtctcttggcttgttacaatatcctcacttgttcagttcgtactcaacaagatggaaagattcagagactttatggtttagctactgttgctaa

SEQ ID NO: 20815 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20816 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaactagcaagtgcttcagttcttcccatgattttgaaatcagctcttgaacttgatctcttagaaattgctaaatggacctgttgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 20817 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaactagcaagtgcttcagttcttcccatgattttgaaatcagctcttgaacttgatctcttagaaattgctaaatggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20818 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctccgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20819 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctacgccatccaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaatgttcagagactttatggtttggctactgttgctaa

SEQ ID NO: 20820 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcgtcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20821 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20822 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcctcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20823 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcctcgccatgcaactagcaagtgcttcagttcttcccatgattttaaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20824 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcatcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20825 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcatcgccatgcaactagcaagtgcttcagttcttcccatgattttgaaatcagctcttgaacttgatctcttagaaatcggcagcgttagggaccgtcgctgtcaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20826 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 20827 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttgaaatcagctcttgaacttgatctcttagaaatctaaagctggacctggagctcaaatttcacctattgaaattgcttctcagctaccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 20828 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 20829 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttgaaatcagctcttgaacttgatctcttagaaatcactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20830 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttgaaatcagctcttgaacttgatctcttagaaagctggacctggtgctcaaatttcacctattgaaattgcttctcagctaccaacaactaagcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20831 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatttcctcactttttcagttcgtactcaacaagatggaaaggttcagagtctttatggtttggctactgttgctaa

SEQ ID NO: 20832 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctattcgcaatgcaattagcaagtgcttcagttcttcccatgattttaaaatcagctctcgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20833 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccgcttcgccatgcaattagcaagtgcttcagttcttcccatgattttaaaatcagctcttgaacttgatctcttagaaatcatatctgctgcttgcaaacaaaaaaaccaccgctaccagctggacctggtgctcaaatttcacctattgaaagtgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20834 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccgcttcgccatgcaactagcaagtgcttcagttcttcccatgattttaaaatcagctcttgaacttgatctcttagaaatcctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20835 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacccttcgccatgcaactagcaagtgcttcagttctccccatgattttaaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20836 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccccttcgccatgcaattagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20837 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccccttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20838 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccccttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20839 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccccttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20840 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccccttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 20841 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccacttcgccatgcaattagcaagtgcttcagttcttcccatgattttaaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20842 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccacttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20843 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccacttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20844 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacatcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20845 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacatcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20846 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacatcttcgccatgaaactagcaagcgcttcagttcttcccatgattttgaaatcagctcttgaacttgatctcttagaaattattaaagctggacatggtgctcagatttcacatattgaaattccttctcagctcccaacaactaaccctggtgcactagttatgttggacagaatgttgcgtctcttggattgttacaatatcctcccttgttcagttcgtactcaacaagatggaaagattcagagactttatggtttggctactgttgctaa

SEQ ID NO: 20847 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacatcttagccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20848 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaactcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20849 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaactcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 20850 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaactcttcgccatgcaactagcaagtgcttcagttcttcccatgattttgaaatcagctcttgaacttgatctcttagaaatgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20851 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaactcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacttttgctaa

SEQ ID NO: 20852 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaagtcattggtgctcagatttcacctattgaaattggttctaagttcccaacaactagccctaatgcaccagttttgttgtaccgaatgttgcgtgtattggcttgttacaatatcctcacttgttaagttcgtactcaacaagatggaaagattcagagtctttatggtttggatactgttgctaa

SEQ ID NO: 20853 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 20854 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaaaaagctggacctggtgctcaaatttcaccaattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20855 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20856 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagaaaacctcttcgccatgcaactagcaagtgcttaagttcttcccatgattttaaaatcagctcttgaacttgatctcttagaaaagctgtacctggtgctcaaatttcacctattgaaattgcttctcagctcccaacaactaaccctgatgcaccagttatgttggaccgaatgttgcgtctcttggcttgttactatatcctcacttgttcagttcgtactcaacaagctggaaaggttcagacactttatggttcggctactgttgctaa

SEQ ID NO: 20857 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagaaaacctcttcgccatgcaactaacaagtgcttcagatctccccatgattttgaaaacagctcttgaacttgatttgttagcaatcactggacctggtgctcaaatttcgcctattgaaattgcttctcagctaccaacaactaactctggtgcaccatttatgttgaaccgaatattgcgtctcttggcttgttacaatatcctcacttgttcagttcgtactcaacaagatggaaagattcagagtctttatggtttggctactgttgctaa

SEQ ID NO: 20858 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaccaaccctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20859 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaccaaacctcttcgccatgcaattagcaagtgcttcagttcttcccatgattttaaaatcagctcttgaacttgatctcttagaaatcgctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20860 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaccaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20861 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20862 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20863 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20864 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20865 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttactaa

SEQ ID NO: 20866 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20867 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaattagcaagtgcttcagttcttcccataaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 20868 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 20869 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20870 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20871 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcggagactttatggtttggctactgttgctaa

SEQ ID NO: 20872 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20873 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20874 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20875 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20876 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20877 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcgctggacctggtgctcaaatttcacctattgaaattgcttctcagctcccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 20878 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20879 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttaaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20880 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20881 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20882 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatcaagaatcaaacctcttcgccatgcaattagcaagggcttcagttcttcccatgattttaaaatcggatcttgaactttatctctaagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 20883 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatcaagaagcagacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 20884 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatcaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20885 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatcaagaagcaaacctcttcgccatgcaactagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20886 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagataaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20887 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagaggaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20888 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagacgaagaagcaaacctcttcgccatgcaattagcaagtgcttcagttcttcccatgattttaaaatcagctcttgaacttgatctcttagagtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20889 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagacgaagaagcaaacctcttcgccatgcaattagcaagtgcttcagttcttcccatgattttaaaatcagctcttgaacttgatctcttagagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20890 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagacgaagaagcaaacctcttcgccatgcaactagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20891 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagacgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20892 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagacgaagaagcaaacctcttcgccatgcaactagcaagtgcttcagttcttcccatgattttgaaatcagctcttgaacttgatctcttagaaaaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20893 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagaagaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20894 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagaagaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20895 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagaagaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20896 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcacatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20897 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaaatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 20898 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaaatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20899 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaaatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 20900 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaaatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20901 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaaatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20902 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaaatgaagaagcaaacctcttcgccatgcaactaccaagtgcttcatttcttcccatgattttgaaatcagctcttgaacttgatctcttagaagctaaagctggacctggtgctcaaattgcacctattgaaattgcttcgcagctaccaacaactaaccctgatgcaccagttatgttggaccgaatgttgcgtctcttggcttgttacaatatactcacttgttgagttcgtactcaacaagatgaaaaagttcagagactttatggttggctactgttgctaa

SEQ ID NO: 20903 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatataagcttccaacaactaaccctgatgcaccagtcatgttggaccgaatgttgcgtctcttggcttgttacaatatcctcacttgttcagttcgtgctcaacaagatggaaagattcagagactttatggtttggctactgttgctaa

SEQ ID NO: 20904 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20905 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaattagcaagtgcttcagttcttcccatgattttgaaatcagctcttgaaattgatctcttagaaattaaagctggaccttgtgctcaaatttcacctattgaaattgcttctctgataccaacaactaaccctgatgcaccagttatgttggaccgaatattgcgtctcttggcttgtttcaatatcctcacttgttcagttcgtactcaacaagattgaaagattcagagactttatggtttggctactgttgctaa

SEQ ID NO: 20906 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20907 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagctggacctggtgctcaaatttcacctattgaaattgcttctcagctactcaccactaaccctgatgcaccagttatgttggaccgaatgttgcgtctcttggcttgttacaatatcctcactttttcagttcgtactcaacaagatggaaattttccgatactttatggtttggctacttttgctaa

SEQ ID NO: 20908 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagaactggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20909 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20910 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatccgcacttgttctgttcgtactcaacaagatggaaaggttcagagcctttatggtttggctactgttgctaa

SEQ ID NO: 20911 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagaaacctggtgctcaaatttcacctattgaaattgcttctcagctacaatcaactaaccctgatgcaccagttatgttggaccgaatgttgcgtctcttggcttgttacaatatcctcactttttcagttcgtactcaacaagatggaaatattccgacactttatggtttggctacttttgctaa

SEQ ID NO: 20912 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaatggttcagagactttatggtttggctactgttgataa

SEQ ID NO: 20913 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccatgcaactagcaagggcttcagttcttcccatgattttgaaatcagctcttgaacttgatctctttaaagctggacctggtgctcaaatttcacctattgaaattgcttctcagctacactcaactaaccctgatgctccagttatgtcggaccgaatgttgcgtctcttggcttgttacaatatcctcactttttcagttcgtactcaacaagatggaaatattccgacactttatggtttggctactgttgctaa

SEQ ID NO: 20914 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatataagatgaagaagcaaacctcttcgccaggcaattagcaagggcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20915 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatataagacgaagaagcaaacctcttcgccatgcaattagcaagtgcttcagttcttcccatgattttaaaatcagctcttgaacttgatctcttagaaattaaagctggacctggtgctcaaatttcacctattggaattgcttctcagctaccaacaactaaccctgatgcaccagttatgttggaccgaatgttgcgtctcttggcttgttacaatatcctcacttgttcagttcgtactcaacaagatggaaagtttcacagcctttatggtttggctactgttgctaa

SEQ ID NO: 20916 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacataccagattaagaagcaaacctcttcgccatgcaactagcaagtgcttcagttcttcccacgattttgaaatcagctcttgaacttgatctcttagaataaagctggacctggtgctcaaatttcacctattgaaattgctgctcagctaccaacaactaagcctgctgcaccagttaggttggaccgaatgttgcgtctcttggcttgttacaatatccacacttgttgagttcgtactcaacaagatggaaagattcagagccattatggtgtggctactgaggctaa

SEQ ID NO: 20917 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacataccagatgaagaagcaaacctcttcgccatgtaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20918 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacataccagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcagcaagatggaaaggttcagagactttatggtttggcgactgatgctaa

SEQ ID NO: 20919 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacataccagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20920 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacataccagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20921 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacataccagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20922 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacataccagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20923 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacataacagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20924 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacataacagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20925 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacataacagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttgtcttgttacaatctcctctcttgttctgttcgtactcaacaagatggaaacgttcagagcctttatggtttggctactgttgctaa

SEQ ID NO: 20926 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacataacagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20927 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacacatcagatgaagaagcaaacctcttcgccatgcaattagcaagtgcttcagttcttctcatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20928 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacacatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20929 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacacatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20930 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20931 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20932 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20933 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20934 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacaaatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20935 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccaaatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgtttcgtctcttggcttgttacaatatcctccctttttcagttcgtactcaacaagatgtaaagattcagagactttatggtttggctactgttgctaa

SEQ ID NO: 20936 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccaaatatcagatgaagaaccaaacctcttcgccatgcaactagcaagtgcttcagttcttcccaggattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20937 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaaccacatctcaaattaagaaacaaacctcctcgcccatccaatagcaagttcctcagttcttcccatgattttaaaagcagctcttgaacttgatctcttagaaatcaagctggacctggtgctcaaatttcacctggtcaaattgcttctcagctgccaacaactaaccctgatgcaccagtcatgttggaccgaatgttgcgtctcttggcttgttacaatatcctcacttgttctgttcgtacgcaacaagatggaaaggttcagagactttatggtttggctactgttgctaa

SEQ ID NO: 20938 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaaccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20939 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaaccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20940 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaaccaacatatcagatgaagaagcaaacctcttcgccatgcaattagcaagtgcttcagttcttcccatgattttaaaatcagctcttgaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20941 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaaggttcagagactttatggtttggctactgttgctaa

SEQ ID NO: 20942 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20943 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20944 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20945 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacacacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatcgtttggctactgttgctaa

SEQ ID NO: 20946 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacacacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctaccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20947 - DNA, 236 bp, Artificial
  MsCOMT deletion introduced by TALEN pair MsCOMT_T02.1
tctcacaaaaacctcatcaatcacaaccatgggttcaacaggtgaaactcaaataacaccaacacacatatcagatgaagaagcaaacctcttcgccatgcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20948 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacacacatatcagatgaacaagcaaacctcttcgccatgtaactagcaagtgcttcagttcttcccatgttttagaaatcagctcttgaacttgctctcttagaaataaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20949 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacacacatataagaggaagaagcaaacctcttcgacatgcaattagcaagtgcttcagttcttcccatgattttgaaatcagctcttgaacttgatctcttagaaattaactctgtacctggttctcaaatttcacctattgaatttgcttctcagctaacaacaactaaccctgatgcaccagttatgttggaccgcatgttacgtctctttacttgccccaagaaccgcacgggggcaggccgtactcaacaagatggaaaatttccacccctttatggcttggctactgttgctaa

SEQ ID NO: 20950 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacacacatataagaggaagaagcaaacctcttcgacatgcaattagcaagtgcttcagttcttcccatgattttaaaatcagctcttgaacttgatctcttagagtgctacagctggacctggtgctcaaatttaacctattgaaattgcttatcagctcccaacaactaaccctgatgcaccagttatgttggaccgtatgtttcgtctcttttcttgccccaagaaccgcacgggggcaggccgtactcaacaagatggaaaatttccacccctttatggtttggctactgttgctaa

SEQ ID NO: 20951 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacacacatataagaggaagaagcaaacctcttcgacatgcaactagcaagtgcttcagttcttcccatgattttgaaatcagctcttgaacttgatctcttagaactaaagctggacctggtgctcaaatttcaactattgaaattgcttctcagttcacaacaactaaccctgatgcaccagttatgttggaccgtatgtttcgtctcttaacttgccccaagaaccgcacgggggcaggccgtactcaacaagatggaaaatttccacctctttatggtttggctactgttgctaa

SEQ ID NO: 20952 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacacacatataagaagaagaagcaaacctcttcgacatgcaactagcaagtgcttcagttcttcccatgattttaaaatcagctcttgaacttgatatcttagaaatctggacctggtgctcaaatttcacctaatgaaattgcttctcagctactaccaactaaccctgatgcaccagttatgttggaccgtatgtttcgtctcttaacttgccccaagaaccgcacgggggcaggacgtactcaacaagatggaaaatttccacccctttatggtttggctactgttgctaa

SEQ ID NO: 20953 - DNA, 198 bp, Artificial
  MsCOMT deletion introduced by TALEN pair MsCOMT_T02.1
tctcacaaaaacctcatcaatcacaaccatgggttcaacaggtgaaactcaaataacaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 20954 - DNA, 198 bp, Artificial
  MsCOMT deletion introduced by TALEN pair MsCOMT_T02.1
tctcacaaaaacctcatcaatcacaaccatgggttcaacaggtgaaactcaaataacaccaacaactaaccctgatgcaccagttatgttggaccgaatgttgcgtctcttggcttgttacaatatcctcacttgttctgttcatactcaacaagatggaaaggttcagagactttatggtttggctactgttgctaa

SEQ ID NO: 20955 - DNA, 198 bp, Artificial
  MsCOMT deletion introduced by TALEN pair MsCOMT_T02.1
tctcacaaaaacctcatcaatcacaaccatgggttcaacaggtgaaactcaaataacaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20956 - DNA, 197 bp, Artificial
  MsCOMT deletion introduced by TALEN pair MsCOMT_T02.1
tctcacaaaaacctcatcaatcacaaccatgggttcaacaggtgaaactcaaataacaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 20957 - DNA, 198 bp, Artificial
  MsCOMT deletion introduced by TALEN pair MsCOMT_T02.1
tctcacaaaaacctcatcaatcacaaccatgggttcaacaggtgaaactcaaataacaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20958 - DNA, 198 bp, Artificial
  MsCOMT deletion introduced by TALEN pair MsCOMT_T02.1
tctcacaaaaacctcatcaatcacaaccatgggttcaacaggtgaaactcaaataacaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20959 - DNA, 198 bp, Artificial
  MsCOMT deletion introduced by TALEN pair MsCOMT_T02.1
tctcacaaaaacctcatcaatcacaaccatgggttcaacaggtgaaactcaaataacaccaacaactaaccctgatgcaccagttatcttggaccgaatgttgcgtctcttggcttgttacaatatcctcacttgttcagttcgtactcaacaagatggaaaggttcagagactttatggtttggctactgttgctaa

SEQ ID NO: 20960 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaaaccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20961 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaaaccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20962 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaaaccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctaccaacaactaaccctgatgctccagttatgttggaccgaattttgcgtctcttggcttgttacaatatcctcacttgttcagttcgtactcaacaagatggaaaggttcagagactttatggtttggctactgttgctaa

SEQ ID NO: 20963 - DNA, 360 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20964 - DNA, 357 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggacctaatgttgcgtctcttggcttgttacaatatcctcacttgttcagttcttactcaacaagatggaaaggttcagagtctttatggtttggctactgttgctaa

SEQ ID NO: 20965 - DNA, 342 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20966 - DNA, 360 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcttcgccatgcaactagcaagtgtttcagttcatcacatgatcttgaaatcagctcttgaacatgatctcttagaaattaaagctggacctggtgcttaaatttcatctattgaaattgcttcacagatgccaacaacttaccctaatgcaccagttatgtcggaccgaatgttacgtctcttggcttgttacaaaatcctcacttgttcagttcgtactcaacgagatggaaaggttcacagactttatggtttggcttcagttgctac

SEQ ID NO: 20967 - DNA, 361 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20968 - DNA, 358 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20969 - DNA, 356 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttattgtttggctactggtgctaa

SEQ ID NO: 20970 - DNA, 361 bp, Artificial
  MsCOMT deletion introduced by TALEN pair MsCOMT_T02.1
tctcacaaaaacctcatcaatcacaaccatgggttcaacaggtgaaactcaaataacacaaacccacatatcagatgaagaagcaaacctcatcgccatgcaattagcaagtgcttcagttcttcccatgattttaaaatcagctcttgaacttgatctcttagaaatctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaagtttcagagactttattgcttggctactgttgctaa

SEQ ID NO: 20971 - DNA, 360 bp, Artificial
  MsCOMT deletion introduced by TALEN pair MsCOMT_T02.1
tctcacaaaaacctcatcaatcacaaccatgggttcaacaggtgaaactcaaataacaacaacccacatatcagatgaagaagcaaacctcttcgccatgcaattagcacgtgcttcagttcttcccatgattttaaaatcagctcttgcacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaagattcagagtctttatggtttggctactgtggctaa

SEQ ID NO: 20972 - DNA, 435 bp, Artificial
  MsCOMT deletion introduced by TALEN pair MsCOMT_T02.1
tctcacaaaaacctcatcaatcacaaccatgggttcaacaggtgaaactcaaataacaacaacccacatatcagatgaagaagcaaacctcttcgccatgcaattagcaagtgcttcagttcttcccatgattttaaaatcagctcttgaacttgatctcttagaaattccagcggctgttgccggtgctgtgccaggcctacggcttgaccccggagcaggtggtggccatcgccagccacgatggcggcaagcaggcgctggaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20973 - DNA, 358 bp, Artificial
  MsCOMT deletion introduced by TALEN pair MsCOMT_T02.1
tctcacaaaaacctcatcaatcacaaccatgggttcaacaggtgaaactcaaataacaacaacccacatatcagatgaagaagcaaacctcttcgccatgcaattagcaagtgcttcagttcttcccatgattttaaaatcagctcttgaacttgatctcttagaaataagctggacctggttctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 20974 - DNA, 359 bp, Artificial
  MsCOMT deletion introduced by TALEN pair MsCOMT_T02.1
tctcacaaaaacctcatcaatcacaaccatgggttcaacaggtgaaactcaaataacaacaacccacatatcagatgaagaagcaaacctcttcgccatgcaactagcaagtgcttcagatcttcccatgattttgaaatcagctcttgaacttgatctcttagaaataaagctgggcctggtgctcaaatttcacctattgaaattgcttctcagctcccaacaactaaccctgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 20975 - DNA, 361 bp, Artificial
  MsCOMT deletion introduced by TALEN pair MsCOMT_T02.1
tctcacaaaaacctcatcaatcacaaccatgggttcaacaggtgaaactcaaataaaaccaacccacatatcagatgaagaagcaaacctcttcgccatgcaattagcaagtgcttcagttcttcccatgattttaaaatcagctcctgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20976 - DNA, 354 bp, Artificial
  MsCOMT deletion introduced by TALEN pair MsCOMT_T02.1
tctcacaaaaacctcatcaatcacaaccatgggttcaacaggtgaaactcaaataaaaccaacccacatatcagatgaagaagcaaacctcttcgccatgcaactaccaagtgcttcagttcttcccatgattttgaaatcagctcttgaacttgatctcttagaagctggacctggtgctcaaatttcacctattgaaattgcttctcagctaccaacaactaaccctgatgcgccagttatgttggaccgaatgttgcgtctcttgggttgttacaatatcctcacttgttcagttcgttctcaacgagatggaaaggttcagagactttatggtttggctgctgttgttaa

SEQ ID NO: 20977 - DNA, 355 bp, Artificial
  MsCOMT deletion introduced by TALEN pair MsCOMT_T02.1
tctcacaaaaacctcatcaatcacaaccatgggttcaacaggtgaaactcaaagaacaccaacccacatatcagatgaagaagcaaacctcttcgccatgcaactagcaagtgcttcagttcttcccatgattttgaaatcagctcttgaacttgatctcttagaaatctggacctggtcctcaactttcacatattgaaattgattctcagctaccaacaactcaccgttgtgcaccagttatgttgaaccgattatcgagtctattggcttgttaaaatatcctcacttgttcagttagtactcaacaagattgaaaggttcagagcctttatggtttggctactgttgctaa

SEQ ID NO: 20978 - DNA, 360 bp, Artificial
  MsCOMT deletion introduced by TALEN pair MsCOMT_T02.1
tctcacaaaaacctcatcaatcacaaccatgggttcaacaggtgaaactcaaacaacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20979 - DNA, 359 bp, Artificial
  MsCOMT deletion introduced by TALEN pair MsCOMT_T02.1
tctcacaaaaacctcatcaatcacaaccatgggttcaacaggtgaaactcaaacaacaccaacccacatatcagatgaagaaacaaacctcttcgccatgcaattagcaagtgcttcagttcttcccattattttgaaatccgctcttgaacttgatctcttagaactaaagcttgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20980 - DNA, 362 bp, Artificial
  MsCOMT deletion introduced by TALEN pair MsCOMT_T02.1
tctcacaaaaacctcatcaatcacaaccatgggttcaacaggtgaaactcaaaataacaccaacccacatatcagatgaagacgcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20981 - DNA, 358 bp, Artificial
  MsCOMT deletion introduced by TALEN pair MsCOMT_T02.1
tctcacaaaaacctcatcaatcacaaccatgggttcaacaggtgaaactcaaaaaacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctgttcaaattgcttctcagcttccaacaactaaccctgatgcactagtcatgttggaccgaatgttgcgtctcttggcttgttacaatatcctcacttgttcagttcgtactcaacaagatggaaaggttcagagactttatggtttggctactgttgctaa

SEQ ID NO: 20982 - DNA, 344 bp, Artificial
  MsCOMT deletion introduced by TALEN pair MsCOMT_T02.1
tctcacaaaaacctcatcaatcacaaccatgggttcaacaggtgaaactaaaataacaccaacccacatattagatgaagaagcaaacctcttcgccatgcaattagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20983 - DNA, 339 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctgttcgccatgcaactagcaagtgcttcagttcttcccatgattttgaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgatgctaa

SEQ ID NO: 20984 - DNA, 357 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20985 - DNA, 354 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaagattcagagactttatggtttggctactgttgctaa

SEQ ID NO: 20986 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttctaa

SEQ ID NO: 20987 - DNA, 358 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20988 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20989 - DNA, 358 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20990 - DNA, 353 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20991 - DNA, 360 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20992 - DNA, 360 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20993 - DNA, 360 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 20994 - DNA, 362 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20995 - DNA, 414 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20996 - DNA, 356 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20997 - DNA, 358 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 20998 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 20999 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21000 - DNA, 358 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21001 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21002 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21003 - DNA, 352 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21004 - DNA, 350 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatattctcacttgttcagttcgtactcaacaagatagaaaggttcagagactttatggtttggctactgttactaa

SEQ ID NO: 21005 - DNA, 335 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttctggacctggtgctcaaatttcacctattgaaattgcttctcagctcccaacaactaatcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21006 - DNA, 351 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagtgcttcagttcttccaatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21007 - DNA, 364 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagggcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21008 - DNA, 361 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaattagcaagcgcttcagttcttcccatgattttaaaatcagctcttgaacttgatctcttagaaatctaaagctggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21009 - DNA, 356 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21010 - DNA, 361 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 21011 - DNA, 360 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcccttgttcagttcgtactcaacaagatggaaaggttcagagactttatggtttggctactgttgctaa

SEQ ID NO: 21012 - DNA, 361 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21013 - DNA, 361 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21014 - DNA, 361 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21015 - DNA, 362 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcctaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21016 - DNA, 361 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21017 - DNA, 358 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21018 - DNA, 358 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 21019 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaaggttcagagcctttatggtttggctactgttgctaa

SEQ ID NO: 21020 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21021 - DNA, 356 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21022 - DNA, 358 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatatcttagaaatcatctggacctggtgctcaaatttcacctattgaaattgcttctcagctcccaacaactaaccctgatgcaccagttatgttggaccgaatgttgcgtctcttggcttgggacaagagccgcacgggggcagggcgtactcaacaagatggaaagattcagagactttatggtttggctactgttgctaa

SEQ ID NO: 21023 - DNA, 344 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21024 - DNA, 306 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaaattgcttctcagctaccaacaactaaccctgatgcaccagttatgttggaccgaacgttgcgtctcttggcttgttacaatatcctcacttgttcagttcgtactcaacaagatggaaagattcagagactttatggtttggctactgttgctaa

SEQ ID NO: 21025 - DNA, 346 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttaaaatcagctcttgaacttgatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21026 - DNA, 360 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgcaacaagcaagtgcttcagttcttcccatgattttgaaatcagctcttgaacttgatctcttagaaatcaaagctagacctggtgctcaaatttcacctattgaaattgattctcagctaccaacaactaaccctgatgcaacctttatattgaccgcaatattgcgtcacatggattgtaacaatagcctcaattgtgcagtgcgtactcaacaagatggaaaggttcagagactagatggtttgtctacttatgctaa

SEQ ID NO: 21027 - DNA, 360 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgaaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21028 - DNA, 360 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaagcaaacctcttcgccatgaaactagcaagtgcttcagttcttcccatgattttgaaatcagctattgaacttgatctcttagaaattaaagctggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 21029 - DNA, 359 bp, Artificial
  MsCOMT deletion introduced by TALEN pair MsCOMT_T02.1
tctcacaaaaacctcatcaatcacaaccatgggttcaacaggtgaaactaaaataacaccaacccacatatcagatgaagaaacaaacctcttcgccatgcaactagcaagtgcttcagttcttcccatgattttgaaatcagctcttgaacttgatctcttagaaataaagctgaacctggtgctcaaatttctcctattgaaattgcttctcagctaccaacaactaaccctgatgcaccagttatgttggaacgaatgttgcgtctcttggcttgatgcaatatcctcacttgttcagttcgtactcaacaagatggaaaggttcagagactttatggtttggctactgtggctaa

SEQ ID NO: 21030 - DNA, 357 bp, Artificial
  MsCOMT deletion introduced by TALEN pair MsCOMT_T02.1
tctcacaaaaacctcatcaatcacaaccatgggttcaacaggtgaaacgcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21031 - DNA, 363 bp, Artificial
  MsCOMT deletion introduced by TALEN pair MsCOMT_T02.1
tctcacaaaaacctcatcaatcacaaccatgggttcaacaggtgaaacgcaaataacaccaacccacatatcagatgaagaagcaaacctcttcgccatgcaactagcaagtgcttcagttcttcccatgattttgaaatcagctctcgaacttgatctcttagaaatcattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 21032 - DNA, 363 bp, Artificial
  MsCOMT deletion introduced by TALEN pair MsCOMT_T02.1
tctcacaaaaacctcatcaatcacaaccatgggttcaacaggtgaaacccaaataacaccaacccgcatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaaggttcagagactttatggtttggctactgttgctaa

SEQ ID NO: 21033 - DNA, 358 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21034 - DNA, 352 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaattacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21035 - DNA, 360 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21036 - DNA, 363 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21037 - DNA, 362 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaatcactaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21038 - DNA, 354 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21039 - DNA, 360 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcggctaacaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21040 - DNA, 362 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21041 - DNA, 359 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21042 - DNA, 422 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaataccacctgctccggggtcaagccgtgggcctggcacagcaccggcaacagccgctggaccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21043 - DNA, 360 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21044 - DNA, 353 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21045 - DNA, 353 bp, Artificial
  MsCOMT deletion introduced by TALEN pair MsCOMT_T02.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21046 - DNA, 359 bp, Artificial
  MsCOMT deletion introduced by TALEN pair MsCOMT_T02.1
tctcacaaaaacctcatcaatcacaaccatgggttcaacaggtgaaacccaaataacaccaacccacatataagatgaagaagcaaacctcctcgccatgcaattaccaagtgcttcagttcttcccatgattttaaaaccatctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgagctgaacaagatggaaaggtacagagactttatagtttggttacggttgctaa

SEQ ID NO: 21047 - DNA, 198 bp, Artificial
  MsCOMT deletion introduced by TALEN pair MsCOMT_T02.1
tctcacaaaaacctcatcaatcacaaccatgggttcaacaggtgaaacccaaataacaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21048 - DNA, 356 bp, Artificial
  MsCOMT deletion introduced by TALEN pair MsCOMT_T02.1
tctcacaaaaacctcatcaatcacaaccatgggttcaacaggtgaaacacaaataacaccaacccacatatcagatgaagaagcaaacctcttcgccatgcaattagcaagtgcttcagttcttcccatgattttaaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21049 - DNA, 361 bp, Artificial
  MsCOMT deletion introduced by TALEN pair MsCOMT_T02.1
tctcacaaaaacctcatcaatcacaaccatgggttcaacaggtgaaacacaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21050 - DNA, 359 bp, Artificial
  MsCOMT deletion introduced by TALEN pair MsCOMT_T02.1
tctcacaaaaacctcatcaatcacaaccatgggttcaacaggtgaaacacaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcgcagttatgttggaccgaatgttgcgtctcttggcttgttacaatatcctcacttgttcagttcgtactcaacaagatggaaagattcagagactttatggtttggctactgttgctaa

SEQ ID NO: 21051 - DNA, 358 bp, Artificial
  MsCOMT deletion introduced by TALEN pair MsCOMT_T02.1
tctcacaaaaacctcatcaatcacaaccatgggttcaacaggtgaaacacaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21052 - DNA, 361 bp, Artificial
  MsCOMT deletion introduced by TALEN pair MsCOMT_T02.1
tctcacaaaaacctcatcaatcacaaccatgggttcaacaggtgaaacacaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21053 - DNA, 359 bp, Artificial
  MsCOMT deletion introduced by TALEN pair MsCOMT_T02.1
tctcacaaaaacctcatcaatcacaaccatgggttcaacaggtgaaacacaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21054 - DNA, 356 bp, Artificial
  MsCOMT deletion introduced by TALEN pair MsCOMT_T02.1
tctcacaaaaacctcatcaatcacaaccatgggttcaacaggtgaaaatcaaataacaccaacccacatatcagatgaagaagcaaacctcttcgtcatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21055 - DNA, 361 bp, Artificial
  MsCOMT deletion introduced by TALEN pair MsCOMT_T02.1
tctcacaaaaacctcatcaatcacaaccatgggttcaacaggtgaaaatcaaataacaccaacccacatatcagatgaagaagcaaacctcttcgccatggaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21056 - DNA, 359 bp, Artificial
  MsCOMT deletion introduced by TALEN pair MsCOMT_T02.1
tctcacaaaaacctcatcaatcacaaccatgggttcaacaggtgaaaatcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21057 - DNA, 354 bp, Artificial
  MsCOMT deletion introduced by TALEN pair MsCOMT_T02.1
tctcacaaaaacctcatcaatcacaaccatgggttcaacaggtgaaaatcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21058 - DNA, 353 bp, Artificial
  MsCOMT deletion introduced by TALEN pair MsCOMT_T02.1
tctcacaaaaacctcatcaatcacaaccatgggttcaacaggtgaaaatcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 21059 - DNA, 359 bp, Artificial
  MsCOMT deletion introduced by TALEN pair MsCOMT_T02.1
tctcacaaaaacctcatcaatcacaaccatgggttcaacaggtcaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21060 - DNA, 357 bp, Artificial
  MsCOMT deletion introduced by TALEN pair MsCOMT_T02.1
tctcacaaaaacctcatcaatcacaaccatgggttcaacaggtaaaactcaaataacaccaacccacatatcagatgaagaagcaaacctcttcgccatgcaactagcaagtgcttcagttcttcccatgattttgaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21061 - DNA, 359 bp, Artificial
  MsCOMT deletion introduced by TALEN pair MsCOMT_T02.1
tctcacaaaaacctcatcaatcacaaccatgggttcaacaggtaaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21062 - DNA, 358 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccctgaaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21063 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 21064 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgtccagttcgtactcaacaagatggaaagattcagagactttatggtttggctactgttgctaa

SEQ ID NO: 21065 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21066 - DNA, 320 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21067 - DNA, 354 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21068 - DNA, 353 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21069 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21070 - DNA, 362 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccggatggaaaagttcagagactttatggtttggatactgttgctaa

SEQ ID NO: 21071 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21072 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21073 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatctaaagcttgacctggtgctcaaatttcacctattgaaattgtttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21074 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21075 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21076 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtactcaaatttcacctattgaaattgcgtctcagctcccaacaactaaccctgatgcaccagttatgttggaccgaatgttgcgtctcttggcttgttacaatatcctcacttgttcagttcttacgcaacaagattgaaaggttcagagactttatggtttggctactgttgctaa

SEQ ID NO: 21077 - DNA, 356 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21078 - DNA, 362 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21079 - DNA, 393 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21080 - DNA, 358 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcagctggacctggtgcttaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21081 - DNA, 357 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21082 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21083 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatagcctcacttgttcagttcgtactcaataagatggaaagattcagagactgtatggtttggctactgttgctaa

SEQ ID NO: 21084 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21085 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21086 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21087 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtccgcaacaagatgtaaaggttcagagactttatggtttggctactgttgctaa

SEQ ID NO: 21088 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21089 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21090 - DNA, 356 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21091 - DNA, 356 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21092 - DNA, 356 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21093 - DNA, 353 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21094 - DNA, 353 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21095 - DNA, 351 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21096 - DNA, 351 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 21097 - DNA, 352 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21098 - DNA, 350 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgtttgaccgaatgttgcgtctcttggcttgttacaatatcctcacttgttctgttcgtactcaacaagatggaaaggttcagagactttatggtttggctactgttgctaa

SEQ ID NO: 21099 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaaattgatctcttagaactaaagctggacctggtgctcaaatttcacctattgaaattgcttctcagctcccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 21100 - DNA, 353 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaattagcaagggcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21101 - DNA, 356 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactggcaagggcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21102 - DNA, 349 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21103 - DNA, 351 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21104 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaattaaagctggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacttatggtttggctactgttgctaa

SEQ ID NO: 21105 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 21106 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgtgggaccgagtgttgcgtctcttggcttgttacaatatcctcacttgttcagttcgtactcaacaagatggaaaggttcagagactttatggtttggctactgttgctaa

SEQ ID NO: 21107 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcacctaccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21108 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21109 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctca

SEQ ID NO: 21110 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21111 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21112 - DNA, 367 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21113 - DNA, 365 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21114 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21115 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21116 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaataaagcttgacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21117 - DNA, 358 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgaggcaccagttatgttggaccgaatgttgcgtctcttggcttgttacaatatcctcacttgttcagttcgtactcaacaagatggaaaggttcagagactttatggttggctactgttgctaa

SEQ ID NO: 21118 - DNA, 359 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21119 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21120 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21121 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21122 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaactaaagctggacctggagctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21123 - DNA, 356 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 21124 - DNA, 346 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21125 - DNA, 350 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccatcaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 21126 - DNA, 360 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21127 - DNA, 355 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21128 - DNA, 343 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttccaatgattttgaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21129 - DNA, 361 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgcttcagttcttccaatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21130 - DNA, 352 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcgccatgcaactagcaagtgattcagttcttcccatgattttaaaatcagctcttgaacttgatctctaaagctggacctggtgctcaaatttcacctattgaaattgcttctcagctcccaacatctacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21131 - DNA, 290 bp, Artificial
  MsCOMT deletion introduced by TALEN pair MsCOMT_T02.1
tctcacaaaaacctcatcaatcacaaccatgggttcaacaggggaaactcaaataacaccaacccacatatcagatgaagaagcaaacctcttcaccatgcaattagcaagtgcttcagttcttcacctattgaaattgcttctcagctcccaacaactaaccctgatgcaccagttatgttgaaccgaatgttgcgtctcttggcttgttacaatatcctcacttgttctgttcgtactcaacaagatggaaaggttcagagactttatggtttggctactgttgctaa

SEQ ID NO: 21132 - DNA, 361 bp, Artificial
  MsCOMT deletion introduced by TALEN pair MsCOMT_T02.1
tctcacaaaaacctcatcaatcacaaccatgggttcaacaggggaaactcaaataacacaaacccacatataagatgaagaagcaaacctcttggacatgaaattaacaagtgcttcagttctaccaatgatttgaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctcctgttgctaa

SEQ ID NO: 21133 - DNA, 359 bp, Artificial
  MsCOMT deletion introduced by TALEN pair MsCOMT_T02.1
tctcacaaaaacctcatcaatcacaaccatgggttcaacaggggaaactcaaataacacaaacccacatataagatgaagaagcaaacctcttcgccatgcaattagcaagtgcttcagttctccccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21134 - DNA, 357 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcacacctcttcgccatgcaattagcaagtgcttcagttcttcctatgattttaaaatcagctcttgaacttgatctcttagctaaagctggacctggtgctcaaatttcacctattgaacttgcttctcagctcccaacaactaaccctgatgcaccagttatgttgaaccgaatgttgcgtctcttggcttgtgacaataccctcacttgttcagttcgtactcaacaagatggaaagattcagagactttatggtttggctactgttgctaa

SEQ ID NO: 21135 - DNA, 354 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21136 - DNA, 357 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttgaaatcagctcttgaacttgatctcttagaaaaaactggaactggtgctcaaatttcacctattgaaattgcttctcagctaccaacaactaacccttgtgaacccgttacgttgggccgaatgttgcgtctcctggctttgtacaaaatcctccctttgtcagttcgtacccaacaaggtggaaaggttcagaaactttatggtttggctactgttgctaa

SEQ ID NO: 21137 - DNA, 344 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21138 - DNA, 361 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttgaaatcagctcttaaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21139 - DNA, 347 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcatcaaggtgaaaaagttcagagacttcatggtttggctacttttgctaa

SEQ ID NO: 21140 - DNA, 358 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagagtaaagctggacctgatgttcaaatttcacctattgaaatttcttctcagctcccaacaactaaccctgatgcaccagttatgttggaccgaatgttgagtctcttggcttgttacaatatcctctcttgttcagttcgtaatcaacaagatggaaagattcagagactttatggtttggctactgttgctaa

SEQ ID NO: 21141 - DNA, 360 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21142 - DNA, 359 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacacctaaccctgatgcaccagttatgttggaccgaatgttgcgtctcttgtcttgttacaatctcctcactttttcagttcgtactcaacaagatggaaagattcagagactttatggtttggctactgttgctaa

SEQ ID NO: 21143 - DNA, 354 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21144 - DNA, 360 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21145 - DNA, 361 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21146 - DNA, 359 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21147 - DNA, 359 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21148 - DNA, 359 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21149 - DNA, 355 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccggttatgttggaccgaatgttgcgtctcttggcttgttacaatatcctcacttgttcagttcgtactcaacaagatggaaagattcagagactttatggtttggctactgttgctaa

SEQ ID NO: 21150 - DNA, 356 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21151 - DNA, 353 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21152 - DNA, 353 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21153 - DNA, 361 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattagcaagcgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21154 - DNA, 360 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaattaacacctgcttcagttcttcccatgattttaaaatcagctcttgaacttgatctcttagaaatcattgctggacctggtgctcaaatttcacctattgaaattgcctctcagctcccaacaactatccctgatgcaccagttatgttggaccgaatgttgcgtcccttggcttgttacactatcctcacttgttcagttcgtactcaacaagatggaaagattcagagactttatggtttggctactgttgctaa

SEQ ID NO: 21155 - DNA, 359 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21156 - DNA, 361 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21157 - DNA, 361 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21158 - DNA, 347 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctaccaacaactaaccctgatgcaccagtcatgttggaccgaatgttgcgtctcttggcttgttacaatatcctcccttgttctgttcgtactcaacaagatggaaaggttcagagactttatggtttggctactgttgctaa

SEQ ID NO: 21159 - DNA, 362 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21160 - DNA, 361 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21161 - DNA, 357 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21162 - DNA, 355 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21163 - DNA, 355 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21164 - DNA, 356 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21165 - DNA, 353 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21166 - DNA, 352 bp, Artificial
  MsCOMT deletion introduced by TALEN pair MsCOMT_T02.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21167 - DNA, 358 bp, Artificial
  MsCOMT deletion introduced by TALEN pair MsCOMT_T02.1
tctcacaaaaacctcatcaatcacaaccatgggttcaacaggcgaaactcaaataacaccaacccacataacagatgaagaaacaaacctcttcgccatgcaattagcaagtgcttcagttcttcccatgcttttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggttgggcgactgttgcgaa

SEQ ID NO: 21168 - DNA, 363 bp, Artificial
  MsCOMT deletion introduced by TALEN pair MsCOMT_T02.1
tctcacaaaaacctcatcaatcacaaccatgggttcaacaggagaaactcgaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21169 - DNA, 358 bp, Artificial
  MsCOMT deletion introduced by TALEN pair MsCOMT_T02.1
tctcacaaaaacctcatcaatcacaaccatgggttcaacaggagaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21170 - DNA, 358 bp, Artificial
  MsCOMT deletion introduced by TALEN pair MsCOMT_T02.1
tctcacaaaaacctcatcaatcacaaccatgggttcaacaggagaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21171 - DNA, 345 bp, Artificial
  MsCOMT deletion introduced by TALEN pair MsCOMT_T02.1
tctcacaaaaacctcatcaatcacaaccatgggttcaacaggagaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgtttaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21172 - DNA, 357 bp, Artificial
  MsCOMT deletion introduced by TALEN pair MsCOMT_T02.1
tctcacaaaaacctcatcaatcacaaccatgggttcaacaggagaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21173 - DNA, 360 bp, Artificial
  MsCOMT deletion introduced by TALEN pair MsCOMT_T02.1
tctcacaaaaacctcatcaatcacaaccatgggttcaacaggagaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21174 - DNA, 361 bp, Artificial
  MsCOMT deletion introduced by TALEN pair MsCOMT_T02.1
tctcacaaaaacctcatcaatcacaaccatgggttcaacagatgaaactcaaataacaccaacccacctatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaaggttcagagactttatggtttggctactgttgctaa

SEQ ID NO: 21175 - DNA, 432 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaagcctcttcgccatgcaattagcaagtgcttcagttcttcccatgattttaaaatcagctcttgaacttgatctcttagaaatcatttacgccaacggttgaagtgccgatttgcggtcacgcgacagtagctgcgcactatgtacgtgcgaaggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21176 - DNA, 356 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21177 - DNA, 353 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21178 - DNA, 353 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21179 - DNA, 360 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21180 - DNA, 356 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21181 - DNA, 356 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21182 - DNA, 360 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21183 - DNA, 359 bp, Artificial
  MsCOMT deletion introduced by TALEN pair MsCOMT_T02.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21184 - DNA, 222 bp, Artificial
  MsCOMT deletion introduced by TALEN pair MsCOMT_T02.1
tctcacaaaaacctcatcaatcacaaccatgggttcaacacttgaaactcaaatttcacctcttgaaattgattataagctaccaaccactaaccctgatgcaccagttattttggaccgaatgttgcgtctcttggcttgttacaatatcctcactttttcagttcgtactcaacaagatggaaaggttcagagactttatggtttggctactgttgctaa

SEQ ID NO: 21185 - DNA, 349 bp, Artificial
  MsCOMT deletion introduced by TALEN pair MsCOMT_T02.1
tctcacaaaaacctcatcaatcacaaccatgggttcaacacgtgaaactcaaataacaccaacccacatatcagatgaagaagcaaacctcttcgccatgcaattagcaagtgcttcagttcttcccatgattttaaaatcagctcttgaacattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21186 - DNA, 359 bp, Artificial
  MsCOMT deletion introduced by TALEN pair MsCOMT_T02.1
tctcacaaaaacctcatcaatcacaaccatgggttcaacaagtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21187 - DNA, 361 bp, Artificial
  MsCOMT deletion introduced by TALEN pair MsCOMT_T02.1
tctcacaaaaacctcatcaatcacaaccatgggttcaacaagtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21188 - DNA, 358 bp, Artificial
  MsCOMT deletion introduced by TALEN pair MsCOMT_T02.1
tctcacaaaaacctcatcaatcacaaccatgggttcaacaagtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 21189 - DNA, 359 bp, Artificial
  MsCOMT deletion introduced by TALEN pair MsCOMT_T02.1
tctcacaaaaacctcatcaatcacaaccatgggttcaacaagtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21190 - DNA, 359 bp, Artificial
  MsCOMT deletion introduced by TALEN pair MsCOMT_T02.1
tctcacaaaaacctcatcaatcacaaccatgggttcaacaagtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21191 - DNA, 360 bp, Artificial
  MsCOMT deletion introduced by TALEN pair MsCOMT_T02.1
tctcacaaaaacctcatcaatcacaaccatgggttcaacaagtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21192 - DNA, 361 bp, Artificial
  MsCOMT deletion introduced by TALEN pair MsCOMT_T02.1
tctcacaaaaacctcatcaatcacaaccatgggttcaacaagtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21193 - DNA, 355 bp, Artificial
  MsCOMT deletion introduced by TALEN pair MsCOMT_T02.1
tctcacaaaaacctcatcaatcacaaccatgggttcaacaagtgaaactaaaataacaccaaccaacatatcagatgaagaagcaaacctcttagccatgcaaatagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgagacaatatcctcacttgttcagttcgtactcaacaagatggaaaggttcagagactttatggtttggttactgttgctaa

SEQ ID NO: 21194 - DNA, 361 bp, Artificial
  MsCOMT deletion introduced by TALEN pair MsCOMT_T02.1
tctcacaaaaacctcatcaatcacaaccatgggttcaaaaggtgaaactcaaataacaccaacccacatatcagatgaagaagcaaacctcttcgccctgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttgcaccgaatgttgcgtcgcttggcttgttacagtatacgagcctgtgcagatcttgcgcatcaatacggaaaagatcagtatctgcatggataggggactgtcattaa

SEQ ID NO: 21195 - DNA, 359 bp, Artificial
  MsCOMT deletion introduced by TALEN pair MsCOMT_T02.1
tctcacaaaaacctcatcaatcacaaccatgggttcaaaaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21196 - DNA, 359 bp, Artificial
  MsCOMT deletion introduced by TALEN pair MsCOMT_T02.1
tctcacaaaaacctcatcaatcacaaccatgggttaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21197 - DNA, 311 bp, Artificial
  MsCOMT deletion introduced by TALEN pair MsCOMT_T02.1
tctcacaaaaacctcatcaatcacaaccatgggttaacaggcgaaactcaaataacaccaacccacatatcagatgaagaagcaaacctcttcgccatgcaactagcaagtgcttcagttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21198 - DNA, 360 bp, Artificial
  MsCOMT deletion introduced by TALEN pair MsCOMT_T02.1
tctcacaaaaacctcatcaatcacaaccatgggttaaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctcaaatttaacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21199 - DNA, 358 bp, Artificial
  MsCOMT deletion introduced by TALEN pair MsCOMT_T02.1
tctcacaaaaacctcatcaatcacaaccatgggttaaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21200 - DNA, 362 bp, Artificial
  MsCOMT deletion introduced by TALEN pair MsCOMT_T02.1
tctcacaaaaacctcatcaatcacaaccatgggttaaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21201 - DNA, 357 bp, Artificial
  MsCOMT deletion introduced by TALEN pair MsCOMT_T02.1
tctcacaaaaacctcatcaatcacaaccatgggttaaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 21202 - DNA, 357 bp, Artificial
  MsCOMT deletion introduced by TALEN pair MsCOMT_T02.1
tctcacaaaaacctcatcaatcacaaccatgggttaaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21203 - DNA, 383 bp, Artificial
  MsCOMT deletion introduced by TALEN pair MsCOMT_T02.1
tctcacaaaaacctcatcaatcacaaccatgggttaaacaggtgaaactcaaataacaccaacccacatatcagatgaagaagcaaacctcttcgccatgcaactagcaagtgcttcagttcttcccatgattttaaaatcagctcttgaacttgatctcttagaaatcattgtgacgctcaagtcagaggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21204 - DNA, 359 bp, Artificial
  MsCOMT deletion introduced by TALEN pair MsCOMT_T02.1
tctcacaaaaacctcatcaatcacaaccatgggtgcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21205 - DNA, 359 bp, Artificial
  MsCOMT deletion introduced by TALEN pair MsCOMT_T02.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcacagactttatggtttggctactgttgctaa

SEQ ID NO: 21206 - DNA, 355 bp, Artificial
  MsCOMT deletion introduced by TALEN pair MsCOMT_T02.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21207 - DNA, 361 bp, Artificial
  MsCOMT deletion introduced by TALEN pair MsCOMT_T02.1
tctcacaaaaacctcatcaatcacaaccatgggtccaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21208 - DNA, 359 bp, Artificial
  MsCOMT deletion introduced by TALEN pair MsCOMT_T02.1
tctcacaaaaacctcatcaatcacaaccatgggtccaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21209 - DNA, 221 bp, Artificial
  MsCOMT deletion introduced by TALEN pair MsCOMT_T02.1
tctcacaaaaacctcatcaatcacaaccatgggtcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21210 - DNA, 354 bp, Artificial
  MsCOMT deletion introduced by TALEN pair MsCOMT_T02.1
tctcacaaaaacctcatcaatcacaaccatgggtcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21211 - DNA, 360 bp, Artificial
  MsCOMT deletion introduced by TALEN pair MsCOMT_T02.1
tctcacaaaaacctcatcaatcacaaccatgggtcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21212 - DNA, 357 bp, Artificial
  MsCOMT deletion introduced by TALEN pair MsCOMT_T02.1
tctcacaaaaacctcatcaatcacaaccatgggtcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21213 - DNA, 359 bp, Artificial
  MsCOMT deletion introduced by TALEN pair MsCOMT_T02.1
tctcacaaaaacctcatcaatcacaaccatgggtcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21214 - DNA, 359 bp, Artificial
  MsCOMT deletion introduced by TALEN pair MsCOMT_T02.1
tctcacaaaaacctcatcaatcacaaccatgggtacaacaggtgaaactcaaataacaccaacccacatatcagatgaagaagcaaacctgttcgccatgcaactagcaagtgcttcagttattcacatgattttgaaatcagctcttgaacttgatctcttagaaataaagctggacctggtgctaaaatttcacctattggaattgcttcgcagctaccaacgactaaccctgatgcaccagttatgttgtaccgaatgttgtgtctcttggcttgtttcaatatcctcacttgttaagttcgtactcaacgagatggaaatgttcacagtcttcatggttaagcgccttttgctaa

SEQ ID NO: 21215 - DNA, 360 bp, Artificial
  MsCOMT deletion introduced by TALEN pair MsCOMT_T02.1
tctcacaaaaacctcatcaatcacaaccatgggtacaacaggtgaaactcaaataacaccaacccacatatcagatgaagaagcaaacctcttcgcaatgcaactagcaagggcttcagttcttcccatgattttgaaatcagctcttgaacttgatctcttagaaagtaaagctgtacctggtgctcaaatttcacctattgaaattgcttctcatctaccaacatctaaccctggtgcaccagttatgttggaccgtaaattgcgtctcttggcttgttactacatcctcacttgttcagttcgttctcaacaagatggaaaagttgagagactttattgttaggctactgttgctaa

SEQ ID NO: 21216 - DNA, 359 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21217 - DNA, 361 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21218 - DNA, 355 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 21219 - DNA, 361 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21220 - DNA, 361 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21221 - DNA, 363 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21222 - DNA, 361 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21223 - DNA, 357 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21224 - DNA, 360 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21225 - DNA, 355 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21226 - DNA, 360 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21227 - DNA, 234 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgttcagttcgtactcaacaagatggaaagattcagagactttatggtttggctactgttgctaa

SEQ ID NO: 21228 - DNA, 440 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaatcataggatcccccaatccctttttcactgcatccagcgcaggacgcccgccgaggcaggccaaggcgacgaggtggttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21229 - DNA, 358 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21230 - DNA, 359 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21231 - DNA, 357 bp, Artificial
  MsCOMT deletion introduced by TALEN pair MsCOMT_T02.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgatattgaaatcagctcttgaacttgatctcttagaaatcgctggacctggtgcacaaatttcacctattgaaattgcttgtcaactcccaacaactaaccctgctgcaccagttatgttggaccgaatgttgcgtctcttggcttgttacaatatcctcacttgttcagttcgtactcaacaagatggaaagattcacagactttatggttaggctactgttgctta

SEQ ID NO: 21232 - DNA, 360 bp, Artificial
  MsCOMT deletion introduced by TALEN pair MsCOMT_T02.1
tctcacaaaaacctcatcaatcacaaccatgggatcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgtaaagattcagagactttatggtttggctactgttgctaa

SEQ ID NO: 21233 - DNA, 359 bp, Artificial
  MsCOMT deletion introduced by TALEN pair MsCOMT_T02.1
tctcacaaaaacctcatcaatcacaaccatgggatcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21234 - DNA, 354 bp, Artificial
  MsCOMT deletion introduced by TALEN pair MsCOMT_T02.1
tctcacaaaaacctcatcaatcacaaccatggcttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21235 - DNA, 345 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21236 - DNA, 355 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21237 - DNA, 356 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21238 - DNA, 357 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21239 - DNA, 353 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcacctgttatgttggaccgaatgttgcgtctcttggcttgttacaatatcctcacttgttcagttcgtactcaacaagatggaaaggttcagagactttatggtttggctactgttgctaa

SEQ ID NO: 21240 - DNA, 361 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21241 - DNA, 359 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21242 - DNA, 358 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21243 - DNA, 348 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21244 - DNA, 355 bp, Artificial
  MsCOMT deletion introduced by TALEN pair MsCOMT_T02.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21245 - DNA, 350 bp, Artificial
  MsCOMT deletion introduced by TALEN pair MsCOMT_T02.1
tctcacaaaaacctcatcaatcacaaccatgcgttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21246 - DNA, 217 bp, Artificial
  MsCOMT deletion introduced by TALEN pair MsCOMT_T02.1
tctcacaaaaacctcatcaatcacaaccatgagttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21247 - DNA, 361 bp, Artificial
  MsCOMT deletion introduced by TALEN pair MsCOMT_T02.1
tctcacaaaaacctcatcaatcacaaccatgagttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21248 - DNA, 360 bp, Artificial
  MsCOMT deletion introduced by TALEN pair MsCOMT_T02.1
tctcacaaaaacctcatcaatcacaaccatgagttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21249 - DNA, 355 bp, Artificial
  MsCOMT deletion introduced by TALEN pair MsCOMT_T02.1
tctcacaaaaacctcatcaatcacaaccatgagttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21250 - DNA, 260 bp, Artificial
  MsCOMT deletion introduced by TALEN pair MsCOMT_T02.1
tctcacaaaaacctcatcaatcacaaccatgagttcaacaggtgaaactcaaataacaccaacccacatatcagatgaagaagcaaacctcttcgccatgcaattagcaagtgcttcagttcttcccataaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21251 - DNA, 359 bp, Artificial
  MsCOMT deletion introduced by TALEN pair MsCOMT_T02.1
tctcacaaaaacctcatcaatcacaaccatgagttcaacagatgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21252 - DNA, 356 bp, Artificial
  MsCOMT deletion introduced by TALEN pair MsCOMT_T02.1
tctcacaaaaacctcatcaatcacaaccatcggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21253 - DNA, 357 bp, Artificial
  MsCOMT deletion introduced by TALEN pair MsCOMT_T02.1
tctcacaaaaacctcatcaatcacaaccataggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 21254 - DNA, 356 bp, Artificial
  MsCOMT deletion introduced by TALEN pair MsCOMT_T02.1
tctcacaaaaacctcatcaatcacaaccataggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21255 - DNA, 361 bp, Artificial
  MsCOMT deletion introduced by TALEN pair MsCOMT_T02.1
tctcacaaaaacctcatcaatcacaaccataggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21256 - DNA, 360 bp, Artificial
  MsCOMT deletion introduced by TALEN pair MsCOMT_T02.1
tctcacaaaaacctcatcaatcacaaccacgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21257 - DNA, 357 bp, Artificial
  MsCOMT deletion introduced by TALEN pair MsCOMT_T02.1
tctcacaaaaacctcatcaatcacaaccacgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21258 - DNA, 352 bp, Artificial
  MsCOMT deletion introduced by TALEN pair MsCOMT_T02.1
tctcacaaaaacctcatcaatcacaaccacgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21259 - DNA, 360 bp, Artificial
  MsCOMT deletion introduced by TALEN pair MsCOMT_T02.1
tctcacaaaaacctcatcaatcacaaccaagggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21260 - DNA, 429 bp, Artificial
  MsCOMT deletion introduced by TALEN pair MsCOMT_T02.1
tctcacaaaaacctcatcaatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcaacgcaattaatacgcgtaccgctagccaggaagagtttgtagaaacgcaaaaaggccatccgtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21261 - DNA, 359 bp, Artificial
  MsCOMT deletion introduced by TALEN pair MsCOMT_T02.1
tctcacaaaaacctcatcaatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21262 - DNA, 359 bp, Artificial
  MsCOMT deletion introduced by TALEN pair MsCOMT_T02.1
tctcacaaaaacctcatcaatcacaacaatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 21263 - DNA, 355 bp, Artificial
  MsCOMT deletion introduced by TALEN pair MsCOMT_T02.1
tctcacaaaaacctcatcaatcacaacaatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21264 - DNA, 306 bp, Artificial
  MsCOMT deletion introduced by TALEN pair MsCOMT_T02.1
tctcacaaaaacctcatcaatcacaaacatgggttcaacgggtgaaactcaaataacaccaacccacatatcagatgaagaagcaaacctcttcgccatgcaattagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21265 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagcagcaaacctcttcgccatgcaattagcaagtgcttcagttcttcccatgattttaaaatcagctcttgaacttgatctcttagaaagctggacctggtgctcaaatttcacctattgaaattgcttctcagctcccatcaactaaccctgatgcaccaattatgttggaccgaatgtatcgtctcatggcttgaaacaatatcctcacttgttcaattcgtactcaacaagatgaaaaaattcagagactttatggtttggctactgttgctaa

SEQ ID NO: 21266 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatggaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21267 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21268 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21269 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21270 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21271 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21272 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21273 - DNA, 353 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21274 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 21275 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21276 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 21277 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttggaccgaaagttgcatctcttggcttgttacaatatcctcacatgatcagttcgtactcaacaagatggaaagattcacagactttatggtttggctactggtgctaa

SEQ ID NO: 21278 - DNA, 354 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21279 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21280 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21281 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 21282 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21283 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21284 - DNA, 347 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21285 - DNA, 353 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21286 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21287 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21288 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21289 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21290 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgctgcgtctcttggcttgttacaatatcctcacttgttcagttcgtactcaacaagatggaaaggttcacagactttatggtttggctactgttgctaa

SEQ ID NO: 21291 - DNA, 356 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21292 - DNA, 362 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctgccaacaactaaccctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 21293 - DNA, 438 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtaaaaagtccgcgttgctggcgtttttccataggctccctctggcaacgctgcgatcatgtcctgatacttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 21294 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21295 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21296 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21297 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21298 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21299 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21300 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21301 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttcgcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21302 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21303 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21304 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21305 - DNA, 356 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacatctaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 21306 - DNA, 356 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21307 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaactaaagctggacctggtgctcaacttgcacctattgaaattgcttctcagctcccaacaactaaccctgatgcaccagttatgttggacctaatgttgcgtctcttggctttttacaatatcctcacttgttcagttcgtactcaacaagatggaaagtttccgagactttatggtttggcttctgttgctaa

SEQ ID NO: 21308 - DNA, 352 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21309 - DNA, 353 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21310 - DNA, 352 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 21311 - DNA, 352 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagcacccaacaactaaccctgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 21312 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcatagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21313 - DNA, 362 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaaacagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21314 - DNA, 319 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttccaatgattttaaaatcagctcttgaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 21315 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21316 - DNA, 234 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgttcagttcgtactcaacaagattgaaaggttcagagactttatggtttggctactgttgctaa

SEQ ID NO: 21317 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21318 - DNA, 320 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagggcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 21319 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21320 - DNA, 353 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcatttcttcccatgattttgaaatcagctcttgaacttgatctcttagaaatggacctggtgctcaaatttcaccacttgaaattgcttctcagctcccaacaactaaccctgatgcaccagttatgttggaccgaatgttgcgtctcttggcttgttacaatatcctcacttgttcagttcgtactcaacaagatggaaagcttcgccgcctttatggtttggctactgttgctaa

SEQ ID NO: 21321 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgtttttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21322 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21323 - DNA, 344 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21324 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21325 - DNA, 351 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtacagagactttatggtttggctactgttgctaa

SEQ ID NO: 21326 - DNA, 354 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatctggaccaggagctcaaatttcacctattgaaattgcttctcagctaccaacaactaaccctgatgcaccagttatgttggaccgaatgttgactctcttggcttgttacaatttcctcactttttcagttcgtactcaacaagatggaaaggttcagagactttatggtttggctactgttgctaa

SEQ ID NO: 21327 - DNA, 354 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21328 - DNA, 354 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21329 - DNA, 353 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcaggtcgtactcaacaagatggaaacgttcagagactttatggtttggctactgttgctaa

SEQ ID NO: 21330 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21331 - DNA, 354 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagcctttatggtttggctactgttgctaa

SEQ ID NO: 21332 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21333 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21334 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21335 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21336 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21337 - DNA, 356 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctccaatttcacctattaaaattgcttctcagctaccaacagcaaaacctgatgcaccagttatgttggaccgatttttgcctctcttggctttttacaatatcctcccttgttcgtttcgtactcaccagaatgaaaggttccggggcctttatgttttggctcctgttgcta

SEQ ID NO: 21338 - DNA, 356 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 21339 - DNA, 362 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21340 - DNA, 362 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21341 - DNA, 406 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21342 - DNA, 365 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21343 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgatcagttcgtactcaacaagatggaaaggttcagagcctttatggtttggctactgttgctaa

SEQ ID NO: 21344 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21345 - DNA, 363 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21346 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21347 - DNA, 385 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacagataaaacgaaaggctcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21348 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtcgcttggattgatacaatatcctcacttgtacagttcgtactcaacaagatggaaaggttcagagcctttatggtttggctactgttgctaa

SEQ ID NO: 21349 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21350 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21351 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21352 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21353 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21354 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21355 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21356 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21357 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21358 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21359 - DNA, 359 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgactcttggcttgttacaatatcctcacttgttcagttcgtactcaacaagatggaaaggttcagagactttatggtttggctactgttgctaa

SEQ ID NO: 21360 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 21361 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21362 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21363 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggaccaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 21364 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21365 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21366 - DNA, 356 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21367 - DNA, 356 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21368 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21369 - DNA, 349 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgctaa

SEQ ID NO: 21370 - DNA, 352 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21371 - DNA, 354 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21372 - DNA, 349 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21373 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 21374 - DNA, 361 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21375 - DNA, 365 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacatggagcgcaaatttcacctagtgaaattgcttctcagctcccaacaactaaccctgatgcaccagttatgttggaccgaatgtggcggctctgggcttgatacaatatcctcacttgttcagttcgtactcaacaagatggaaaggttcagtgactgtatggtttggctactgtagctaa

SEQ ID NO: 21376 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21377 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21378 - DNA, 355 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21379 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatatcttagaaaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacaggtgctaa

SEQ ID NO: 21380 - DNA, 358 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgcaactagcaagtgcttcagttcttaccatgattttgaaatcagctcttgaacttgatctcttagaataaagctggacctagtgctcaaatttcacctattgaaatttcttctcagctaccaacaactaaccctgatgcaccagttatgttggaccgaatgttgcgtctcttggctttttacaatatcctctcttgttcagttcgtactcaacaagatggaaagtttcagattctttatggtttggctactgttgctaa

SEQ ID NO: 21381 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcgccatgaaactagcaagtgcttcagttcttcccatgattttgaaatcagctcttgaacttgttctcttagaaactaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 21382 - DNA, 357 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21383 - DNA, 360 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaagcaaacctcttagccatgaaattagcaagtgcttcagttcttcccatgattttaaaattagctcttgaacttgatctcttagaaatcgaagatggacctggtgctcaaatttcacctgttcaaattgcttctcagcttccaacaactaaccctgatgcaccagtcatgttggaccgaatgtttcgtctcttggcttgttacaatatcctcacttgttcagttcgtactcaacaagatggaaaggttcagagactttatggtttggctactgttgctaa

SEQ ID NO: 21384 - DNA, 363 bp, Artificial
  MsCOMT deletion introduced by TALEN pair MsCOMT_T02.1
tctcacaaaaacctcatcaatcacaaacatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21385 - DNA, 359 bp, Artificial
  MsCOMT deletion introduced by TALEN pair MsCOMT_T02.1
tctcacaaaaacctcatcaatcacaaacatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaaatgcttctcagctcccaacaactaaccctgatgcaccagttatgttggaccgaatgttgcgtctcttggcttgaaacaatatcctcacttgatcagttcgtactcaacaagacggaaaggttcagagactttatggtttggctactgttgctaa

SEQ ID NO: 21386 - DNA, 355 bp, Artificial
  MsCOMT deletion introduced by TALEN pair MsCOMT_T02.1
tctcacaaaaacctcatcaatcacaaacatgggttcaacaggtgaaactaaaataacaccaacccacatataagatgaagaagcaaacctcttcgccatgcaattagcaagtgcttcagttcttcccatgattttgaaatcagctcttgaacttgatctcttagaaagctggacctggtgctcaaatttcacctattttaattgcttctcagataaacacaactaaccctgatgcaccagttctgttggaccgaatgttgcgtctcttggcttgttacactatcctcactttttcagttcgtactcaacaagatggaaatattccgacactttatggtttggctacttttgctaa

SEQ ID NO: 21387 - DNA, 341 bp, Artificial
  MsCOMT deletion introduced by TALEN pair MsCOMT_T02.1
tctcacaaaaacctcatcaatcacaaacatgggttcaacaggggaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21388 - DNA, 353 bp, Artificial
  MsCOMT deletion introduced by TALEN pair MsCOMT_T02.1
tctcacaaaaacctcatcaatcacaaacatgggctcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21389 - DNA, 355 bp, Artificial
  MsCOMT deletion introduced by TALEN pair MsCOMT_T02.1
tctcacaaaaacctcatcaatcaaaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21390 - DNA, 353 bp, Artificial
  MsCOMT deletion introduced by TALEN pair MsCOMT_T02.1
tctcacaaaaacctcatcaatcaaaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaagtttcagagactttatggtttagctactgttgctaa

SEQ ID NO: 21391 - DNA, 355 bp, Artificial
  MsCOMT deletion introduced by TALEN pair MsCOMT_T02.1
tctcacaaaaacctcatcaatcaaaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcacaagttatgttggaccgaatgttgcgtctcttggcttgttacaatatcctcacttgttcagttcgtactcaacaagatggaaaggttcagagactttatggtttggctactgttgctaa

SEQ ID NO: 21392 - DNA, 360 bp, Artificial
  MsCOMT deletion introduced by TALEN pair MsCOMT_T02.1
tctcacaaaaacctcatcaataacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21393 - DNA, 356 bp, Artificial
  MsCOMT deletion introduced by TALEN pair MsCOMT_T02.1
tctcacaaaaacctcatcaataacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21394 - DNA, 361 bp, Artificial
  MsCOMT deletion introduced by TALEN pair MsCOMT_T02.1
tctcacaaaaacctcatcaagcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagttatgttggaccgaatgttgcgtctcttggcttgttacgatatcctcacttgttcagttcgtactcaacaagatggaaaagttcagagactttatggtttggctactgttgctaa

SEQ ID NO: 21395 - DNA, 320 bp, Artificial
  MsCOMT deletion introduced by TALEN pair MsCOMT_T02.1
tctcacaaaaacctcatcaagcacaacaatgggttcaacaggtgaaactaaaataaaacaaacacacaaatcagaggaagaagcaaacctcttcgccatgcaattagcaagtgcttcagttcttcccatgattttaaaatcagctcttgaatttcacctgttcaaattgcttctcagcttccaacaactaaccctgatgcaccagtcattttggaccgactgttgcgtctcttggcttgttacaatatcctcactttttctgttcgtactcaacaagatggaaactttctttcactttatggtttggctactgtttctaa

SEQ ID NO: 21396 - DNA, 342 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaattagcaagtgcttcagttcttcccatgattttgaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21397 - DNA, 360 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21398 - DNA, 357 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21399 - DNA, 357 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21400 - DNA, 358 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21401 - DNA, 361 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21402 - DNA, 361 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21403 - DNA, 361 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21404 - DNA, 361 bp, Artificial
  MsCOMT deletion introduced by TALEN pair MsCOMT_T02.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21405 - DNA, 356 bp, Artificial
  MsCOMT deletion introduced by TALEN pair MsCOMT_T02.1
tctcacaaaaacctcatcaaatcacaaccatgggttcaacaggtgaaactcaactaacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21406 - DNA, 223 bp, Artificial
  MsCOMT deletion introduced by TALEN pair MsCOMT_T02.1
tctcacaaaaacctcatcaaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21407 - DNA, 362 bp, Artificial
  MsCOMT deletion introduced by TALEN pair MsCOMT_T02.1
tctcacaaaaacctcatcaaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21408 - DNA, 342 bp, Artificial
  MsCOMT deletion introduced by TALEN pair MsCOMT_T02.1
tctcacaaaaacctcatcaaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21409 - DNA, 364 bp, Artificial
  MsCOMT deletion introduced by TALEN pair MsCOMT_T02.1
tctcacaaaaacctcatcaaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21410 - DNA, 360 bp, Artificial
  MsCOMT deletion introduced by TALEN pair MsCOMT_T02.1
tctcacaaaaacctcatcaaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21411 - DNA, 354 bp, Artificial
  MsCOMT deletion introduced by TALEN pair MsCOMT_T02.1
tctcacaaaaacctcatcaaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21412 - DNA, 357 bp, Artificial
  MsCOMT deletion introduced by TALEN pair MsCOMT_T02.1
tctcacaaaaacctcatcaaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21413 - DNA, 359 bp, Artificial
  MsCOMT deletion introduced by TALEN pair MsCOMT_T02.1
tctcacaaaaacctcatcaaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21414 - DNA, 359 bp, Artificial
  MsCOMT deletion introduced by TALEN pair MsCOMT_T02.1
tctcacaaaaacctcatcaaacacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21415 - DNA, 360 bp, Artificial
  MsCOMT deletion introduced by TALEN pair MsCOMT_T02.1
tctcacaaaaacctcatcaaacacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21416 - DNA, 221 bp, Artificial
  MsCOMT deletion introduced by TALEN pair MsCOMT_T02.1
tctcacaaaaacctcataatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21417 - DNA, 356 bp, Artificial
  MsCOMT deletion introduced by TALEN pair MsCOMT_T02.1
tctcacaaaaacctcataatcacaaccatgggttcaacaggtgaaactcaaatcacaccaacccacatatcagatgaagaagcaaacctcttcgccattcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21418 - DNA, 360 bp, Artificial
  MsCOMT deletion introduced by TALEN pair MsCOMT_T02.1
tctcacaaaaacctcataatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21419 - DNA, 358 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 21420 - DNA, 353 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccattcaactagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21421 - DNA, 354 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21422 - DNA, 360 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21423 - DNA, 351 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21424 - DNA, 357 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21425 - DNA, 359 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21426 - DNA, 353 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21427 - DNA, 358 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21428 - DNA, 360 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21429 - DNA, 418 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgccgtgggcctggcacagcaccggcaacagcgcctgcaccgtctccagcgcttgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21430 - DNA, 353 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21431 - DNA, 353 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21432 - DNA, 359 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21433 - DNA, 360 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21434 - DNA, 362 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21435 - DNA, 351 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21436 - DNA, 358 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21437 - DNA, 358 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21438 - DNA, 358 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21439 - DNA, 354 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21440 - DNA, 360 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21441 - DNA, 355 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21442 - DNA, 345 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21443 - DNA, 350 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21444 - DNA, 349 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21445 - DNA, 353 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21446 - DNA, 353 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21447 - DNA, 360 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21448 - DNA, 360 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21449 - DNA, 364 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21450 - DNA, 356 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21451 - DNA, 358 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21452 - DNA, 354 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21453 - DNA, 354 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21454 - DNA, 355 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21455 - DNA, 356 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21456 - DNA, 357 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21457 - DNA, 349 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21458 - DNA, 352 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21459 - DNA, 354 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21460 - DNA, 355 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21461 - DNA, 291 bp, Artificial
  MsCOMT deletion introduced by TALEN pair MsCOMT_T02.1
tctcacaaaaacctcataatcacaaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21462 - DNA, 357 bp, Artificial
  MsCOMT deletion introduced by TALEN pair MsCOMT_T02.1
tctcacaaaaacctcataatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21463 - DNA, 361 bp, Artificial
  MsCOMT deletion introduced by TALEN pair MsCOMT_T02.1
tctcacaaaaacctcataaatcacaaccatgggttcaacaggtgaaactcaaataacaccaacccacatatcagatgaagaagcaaacctcttcgccatgcaattagcaagtgcttcagttcttcccatgattttggaatcagctcttgaaattgatctcttagaaatctaaagctggacctggtgctcaaatttcacctattgaaattgcttctcagctaccaacaactaaccctgatgcaccagttatgttggaacgaatgttgtgtctcttggcttgttacaatatcctctcttgttcagttcgtgctcaacaagatggaaagattcagagactttatggtttggctactgttgctaa

SEQ ID NO: 21464 - DNA, 355 bp, Artificial
  MsCOMT deletion introduced by TALEN pair MsCOMT_T02.1
tctcacaaaaacctcataaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21465 - DNA, 361 bp, Artificial
  MsCOMT deletion introduced by TALEN pair MsCOMT_T02.1
tctcacaaaaacctcagcgatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttctaa

SEQ ID NO: 21466 - DNA, 341 bp, Artificial
  MsCOMT deletion introduced by TALEN pair MsCOMT_T02.1
tctcacaaaaacctcagcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagttataaaatttcacctattgaaattgcttctcagctaccaacaactaaccctgatgcaccagttatgttggacctaatgttgcgtctcttggcttgttacaatatcctcacttgttcagttcgtactcaacaagatggaaaggttcagagactttatggtttggctactgtttctaa

SEQ ID NO: 21467 - DNA, 362 bp, Artificial
  MsCOMT deletion introduced by TALEN pair MsCOMT_T02.1
tctcacaaaaacctcagcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21468 - DNA, 359 bp, Artificial
  MsCOMT deletion introduced by TALEN pair MsCOMT_T02.1
tctcacaaaaacctcagcaatcacaacaatgggttcaacaggtgaaactaaaataaaactaacacacaaataagaggaagaagcaaacctcttcgccatgaaactagcaagtgcttcagttcttcccatgattttgaaatcagctcttgaacttgatctcttagaaataaagctggacctggtgctcaaatttaacctattgaaattgcttctcagctaccatcaactaaccctgatgcaccagttattttggaccgactgttgcgtctcttgtcttgttccaatatcctcactttttcagttcgtactcaacaagatggaaactttctcccactttatggtttggctactgttgctaa

SEQ ID NO: 21469 - DNA, 359 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttcaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21470 - DNA, 357 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21471 - DNA, 355 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21472 - DNA, 362 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21473 - DNA, 353 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21474 - DNA, 362 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21475 - DNA, 360 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21476 - DNA, 361 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21477 - DNA, 339 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21478 - DNA, 358 bp, Artificial
  MsCOMT deletion introduced by TALEN pair MsCOMT_T02.1
tctcacaaaaacctcaccaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcacatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21479 - DNA, 358 bp, Artificial
  MsCOMT deletion introduced by TALEN pair MsCOMT_T02.1
tctcacaaaaacctcacaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21480 - DNA, 350 bp, Artificial
  MsCOMT deletion introduced by TALEN pair MsCOMT_T02.1
tctcacaaaaacctcacaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 21481 - DNA, 352 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21482 - DNA, 354 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21483 - DNA, 358 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21484 - DNA, 357 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21485 - DNA, 359 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21486 - DNA, 355 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21487 - DNA, 357 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21488 - DNA, 360 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21489 - DNA, 358 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21490 - DNA, 358 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21491 - DNA, 343 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21492 - DNA, 354 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21493 - DNA, 360 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21494 - DNA, 360 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21495 - DNA, 357 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21496 - DNA, 359 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21497 - DNA, 360 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21498 - DNA, 356 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21499 - DNA, 358 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21500 - DNA, 354 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21501 - DNA, 335 bp, Artificial
  MsCOMT deletion introduced by TALEN pair MsCOMT_T02.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21502 - DNA, 362 bp, Artificial
  MsCOMT deletion introduced by TALEN pair MsCOMT_T02.1
tctcacaaaaacctcaatcaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21503 - DNA, 261 bp, Artificial
  MsCOMT deletion introduced by TALEN pair MsCOMT_T02.1
tctcacaaaaacctcaatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21504 - DNA, 357 bp, Artificial
  MsCOMT deletion introduced by TALEN pair MsCOMT_T02.1
tctcacaaaaacctcaacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21505 - DNA, 302 bp, Artificial
  MsCOMT deletion introduced by TALEN pair MsCOMT_T02.1
tctcacaaaaacctcaacaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21506 - DNA, 355 bp, Artificial
  MsCOMT deletion introduced by TALEN pair MsCOMT_T02.1
tctcacaaaaacctcaacaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21507 - DNA, 360 bp, Artificial
  MsCOMT deletion introduced by TALEN pair MsCOMT_T02.1
tctcacaaaaacctcaaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21508 - DNA, 355 bp, Artificial
  MsCOMT deletion introduced by TALEN pair MsCOMT_T02.1
tctcacaaaaacctcaaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21509 - DNA, 355 bp, Artificial
  MsCOMT deletion introduced by TALEN pair MsCOMT_T02.1
tctcacaaaaacctatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctag

SEQ ID NO: 21510 - DNA, 360 bp, Artificial
  MsCOMT deletion introduced by TALEN pair MsCOMT_T02.1
tctcacaaaaacctatcaatcacaaccatgggttcaacaggtgaaactccaataacaccaacccacatatcagatgaagaagcaaacctcttcgccattcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21511 - DNA, 360 bp, Artificial
  MsCOMT deletion introduced by TALEN pair MsCOMT_T02.1
tctcacaaaaacctatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21512 - DNA, 360 bp, Artificial
  MsCOMT deletion introduced by TALEN pair MsCOMT_T02.1
tctcacaaaaacctatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21513 - DNA, 360 bp, Artificial
  MsCOMT deletion introduced by TALEN pair MsCOMT_T02.1
tctcacaaaaacctatcaatcacaaccatgggttcaacaggtgaaactccaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21514 - DNA, 220 bp, Artificial
  MsCOMT deletion introduced by TALEN pair MsCOMT_T02.1
tctcacaaaaacctatcaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 21515 - DNA, 357 bp, Artificial
  MsCOMT deletion introduced by TALEN pair MsCOMT_T02.1
tctcacaaaaacctatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21516 - DNA, 358 bp, Artificial
  MsCOMT deletion introduced by TALEN pair MsCOMT_T02.1
tctcacaaaaacctatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21517 - DNA, 358 bp, Artificial
  MsCOMT deletion introduced by TALEN pair MsCOMT_T02.1
tctcacaaaaacctatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21518 - DNA, 359 bp, Artificial
  MsCOMT deletion introduced by TALEN pair MsCOMT_T02.1
tctcacaaaaacctatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21519 - DNA, 360 bp, Artificial
  MsCOMT deletion introduced by TALEN pair MsCOMT_T02.1
tctcacaaaaacctatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21520 - DNA, 216 bp, Artificial
  MsCOMT deletion introduced by TALEN pair MsCOMT_T02.1
tctcacaaaaacctatcaatcacaaccatgggttcaacaggtgaaactcaaataacaccaacccacatatcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21521 - DNA, 355 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21522 - DNA, 358 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21523 - DNA, 357 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21524 - DNA, 359 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagatttagagactttatggtttggctactgttgctaa

SEQ ID NO: 21525 - DNA, 351 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctaaagctggacctggtgctcaaatttcacctattgaaattgcttctcagctcccaacaactaatcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21526 - DNA, 343 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21527 - DNA, 350 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21528 - DNA, 353 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttataatatcctcacttgttcagttcgtactcaacaagatggaaagattcagagactttatggtttggctactgttgctaa

SEQ ID NO: 21529 - DNA, 360 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21530 - DNA, 359 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21531 - DNA, 359 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21532 - DNA, 354 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21533 - DNA, 360 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21534 - DNA, 356 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21535 - DNA, 413 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcaactgatccataaacacctttcactgtcaaaattcatcttcatcctcactaaagctggacctggtgctcaaatttcacctattgaaattgcttctcagctaccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 21536 - DNA, 358 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21537 - DNA, 354 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21538 - DNA, 354 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21539 - DNA, 352 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21540 - DNA, 358 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctgatctcttagaaatcaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21541 - DNA, 360 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21542 - DNA, 353 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21543 - DNA, 351 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21544 - DNA, 359 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21545 - DNA, 318 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21546 - DNA, 318 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21547 - DNA, 354 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21548 - DNA, 360 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21549 - DNA, 360 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21550 - DNA, 352 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21551 - DNA, 362 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21552 - DNA, 359 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 21553 - DNA, 358 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21554 - DNA, 359 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21555 - DNA, 351 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21556 - DNA, 352 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21557 - DNA, 340 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21558 - DNA, 358 bp, Artificial
  MsCOMT deletion introduced by TALEN pair MsCOMT_T02.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21559 - DNA, 361 bp, Artificial
  MsCOMT deletion introduced by TALEN pair MsCOMT_T02.1
tctcacaaaaacctaatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21560 - DNA, 357 bp, Artificial
  MsCOMT deletion introduced by TALEN pair MsCOMT_T02.1
tctcacaaaaacctaatcaatcacaaccatgggttcaacaggtgaaactcaaataacaccaacccacatatcagatgaagaagcaaacctcttcgccatgcaattaacaagggcttcagttcttcccatgattttaaaatcagctcttgaacttgatctcttagaaaaagctggaccaggtactcaaatttcaccaattgaaattgcttctcagctcccaacaactaaccctgatgcaccaattatattggaccgaatgttgcgtctcgtgagttgttacaatatgctcgcttgttcagttcgtactcatcaaggtggaaagggtcagagtctttatggtttggctactgtatctaa

SEQ ID NO: 21561 - DNA, 359 bp, Artificial
  MsCOMT deletion introduced by TALEN pair MsCOMT_T02.1
tctcacaaaaacctaatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21562 - DNA, 355 bp, Artificial
  MsCOMT deletion introduced by TALEN pair MsCOMT_T02.1
tctcacaaaaacctaatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21563 - DNA, 353 bp, Artificial
  MsCOMT deletion introduced by TALEN pair MsCOMT_T02.1
tctcacaaaaaccgcagcaatcacaaccatgggttcaacaggggaaactcaaataacaccaacccacatatcagaggaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgtcgcgtctcttggcttgtcacaatatcctcacttgttccgttcgtactcaacaagatgcaacgattcagatactttatcgtttggctactgttgctaa

SEQ ID NO: 21564 - DNA, 356 bp, Artificial
  MsCOMT deletion introduced by TALEN pair MsCOMT_T02.1
tctcacaaaaaccctcatcaatcacaaccatgggttcaacaggtgaaactcaactaacaccaacccacatatcagatgaagacgcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21565 - DNA, 360 bp, Artificial
  MsCOMT deletion introduced by TALEN pair MsCOMT_T02.1
tctcacaaaaaccctcatcaatcacaaccatgggttcaacaggtgaaactcaaataacaccaacccacatatcagatgaagacgcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21566 - DNA, 361 bp, Artificial
  MsCOMT deletion introduced by TALEN pair MsCOMT_T02.1
tctcacaaaaaccctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21567 - DNA, 358 bp, Artificial
  MsCOMT deletion introduced by TALEN pair MsCOMT_T02.1
tctcacaaaaaccctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21568 - DNA, 359 bp, Artificial
  MsCOMT deletion introduced by TALEN pair MsCOMT_T02.1
tctcacaaaaaccctcaatcacaaccatgggttcaacaggtgcaactcaaataacaccaacccacatatcagatgaagaagccaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21569 - DNA, 361 bp, Artificial
  MsCOMT deletion introduced by TALEN pair MsCOMT_T02.1
tctcacaaaaacccctcaatcacaaccatgggttcaacaggtgaaactcaaataacaccaacccacctatcagatgaagaagcaaacctcttcgccatgcaattagcaagttcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21570 - DNA, 406 bp, Artificial
  MsCOMT deletion introduced by TALEN pair MsCOMT_T02.1
tctcacaaaaaccccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21571 - DNA, 357 bp, Artificial
  MsCOMT deletion introduced by TALEN pair MsCOMT_T02.1
tctcacaaaaaccccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21572 - DNA, 358 bp, Artificial
  MsCOMT deletion introduced by TALEN pair MsCOMT_T02.1
tctcacaaaaaccccatcaatcacaaccatgggtcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21573 - DNA, 358 bp, Artificial
  MsCOMT deletion introduced by TALEN pair MsCOMT_T02.1
tctcacaaaaacccatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21574 - DNA, 339 bp, Artificial
  MsCOMT deletion introduced by TALEN pair MsCOMT_T02.1
tctcacaaaaacccatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaactctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21575 - DNA, 359 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacggttgctaa

SEQ ID NO: 21576 - DNA, 358 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21577 - DNA, 355 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21578 - DNA, 352 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21579 - DNA, 358 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21580 - DNA, 360 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21581 - DNA, 360 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21582 - DNA, 358 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21583 - DNA, 360 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 21584 - DNA, 352 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21585 - DNA, 357 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21586 - DNA, 359 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21587 - DNA, 352 bp, Artificial
  MsCOMT deletion introduced by TALEN pair MsCOMT_T02.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21588 - DNA, 353 bp, Artificial
  MsCOMT deletion introduced by TALEN pair MsCOMT_T02.1
tctcacaaaaacccatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21589 - DNA, 357 bp, Artificial
  MsCOMT deletion introduced by TALEN pair MsCOMT_T02.1
tctcacaaaaacccacaatcacaaccatgtgttcaacaggtgcaactcaaataccaccaacccacatatcagatgaagaagccaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21590 - DNA, 336 bp, Artificial
  MsCOMT deletion introduced by TALEN pair MsCOMT_T02.1
tctcacaaaaaccatcaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21591 - DNA, 215 bp, Artificial
  MsCOMT deletion introduced by TALEN pair MsCOMT_T02.1
tctcacaaaaaccatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21592 - DNA, 355 bp, Artificial
  MsCOMT deletion introduced by TALEN pair MsCOMT_T02.1
tctcacaaaaaccatcaatcacaaccatgggttcaacaggtgaaactcaaataacaccaacccacatatcagatgaagaagccaacctcttcgccatgcaattagcaagtgcttcagttcttcccatgattttgaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21593 - DNA, 355 bp, Artificial
  MsCOMT deletion introduced by TALEN pair MsCOMT_T02.1
tctcacaaaaaccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21594 - DNA, 393 bp, Artificial
  MsCOMT deletion introduced by TALEN pair MsCOMT_T02.1
tctcacaaaaaccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatatctgctgcttgcaaacaaaaaaaccaccgctaccagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21595 - DNA, 358 bp, Artificial
  MsCOMT deletion introduced by TALEN pair MsCOMT_T02.1
tctcacaaaaaccacatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21596 - DNA, 419 bp, Artificial
  MsCOMT deletion introduced by TALEN pair MsCOMT_T02.1
tctcacaaaaaccacatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggtggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21597 - DNA, 357 bp, Artificial
  MsCOMT deletion introduced by TALEN pair MsCOMT_T02.1
tctcacaaaaacatcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21598 - DNA, 360 bp, Artificial
  MsCOMT deletion introduced by TALEN pair MsCOMT_T02.1
tctcacaaaaaactctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatataaagctggacctggtgctcaaatttcacctattgaaattgcttctcagctaccaacaactaaccctgatgcaccagtcatgttggaccgaatgttgcgtctcttggcttgttacaatatcctcacttgttcttttcgtactcaacaagatggaaaggttcagagactttatggtttggctactgttgctaa

SEQ ID NO: 21599 - DNA, 353 bp, Artificial
  MsCOMT deletion introduced by TALEN pair MsCOMT_T02.1
tctcacaaaaaactcatcaatcacccccatgggttcaacaggtgaaactcaaataaccccaacccccctctccgctgacgaagcaaacctcttcgccatgcaactagcaagtgcttcagttcttcccatgattttgaaatcagctcttgaacttgatctcttaaagcttgacctggtgctcacctttcacctattgaacttgcttctcagctaccaacatctcaccctgctgcaccagttatcttggaccgaatgttgcgtctcttggcttgttacactatcctgacggattcagttcgtactcaacaagatggaaaggttcagacactttatggtttgtctactgttgctaa

SEQ ID NO: 21600 - DNA, 360 bp, Artificial
  MsCOMT deletion introduced by TALEN pair MsCOMT_T02.1
tctcacaaaaaactcatcaatcacaaccatgggttcaacaggtgaaactcatataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgtttgaccgaatgttgcgtctcttgtctttttacaatatcctcacttgttcagttcgtactcaacaagatggaaatgttcagatactttatggtttggctactgttgctaa

SEQ ID NO: 21601 - DNA, 359 bp, Artificial
  MsCOMT deletion introduced by TALEN pair MsCOMT_T02.1
tctcacaaaaaactcatcaatcacaaccatgggttcaacaggtgaaactcaactaacaccaacccacatataagatgaagaagcaaacctcttcgccatgcaactaccaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcgtgtgacaataaccacacttgttcagttcgtactcaacaagatggaaaggatcagagactttatggtttggctactgttgctaa

SEQ ID NO: 21602 - DNA, 360 bp, Artificial
  MsCOMT deletion introduced by TALEN pair MsCOMT_T02.1
tctcacaaaaaactcatcaatcacaaccatgggttcaacaggtgaaactcaaataacaccaagccacatatcagatgaagaagcaaacctcttcgccatgcaattagcaagtgcttcagttcttcccatgattttaaaatcagctcttgaacttgatctcttagaaattaaagctggtactggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21603 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccgtgaaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21604 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaatctaaagctggacctggtgctcaactttcacctattgaaattgcttctcagctacaaacaactatccctgatgcaccagttatgttggaccgaatgttgcgtctcttggcttgttccaatatcctcccttgttcagttcgtactcaacaagatggacaggttcagagactttatggtttggctactgttgctca

SEQ ID NO: 21605 - DNA, 357 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaggtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggtccgaatgttgcgtctcttggcttgttacaatatcctcacttgttcagttcgtactcaacaagatggaaaggttcagagactttatggtttggctactgttgctaa

SEQ ID NO: 21606 - DNA, 351 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21607 - DNA, 476 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagacggtccagcgcctgcttgccaccgccattgctggcgatggccaccacctgctggggggtcaagttgagcgggcctggcacagcacctgcaacagccgctggaccgtctccagcgcctgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgtagctaa

SEQ ID NO: 21608 - DNA, 343 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatgctcaaatttcacctattgaaattgcttctcagctaccagcaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 21609 - DNA, 356 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttgtcttgttacaatatcctcacttgttcagttcgtactcaacaagatggaaaggttcagagcctttatggtttggctactgttgctaa

SEQ ID NO: 21610 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21611 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21612 - DNA, 363 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaatttcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21613 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21614 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaagattcagagactttatggtttggctacgttgctaa

SEQ ID NO: 21615 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21616 - DNA, 354 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagctggaaagattcagagactttatggtttggctactgttgtaa

SEQ ID NO: 21617 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21618 - DNA, 345 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21619 - DNA, 354 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21620 - DNA, 354 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctaaaatatcacctcttgaaattgcttctcagctaccaacaactaaccctgatgcaccagttatgttggaaagaatgttgcgtatcttgggttgttacaatatcctcacttgttcagttcgtactaaacaagatggaaaggttcagagaatgtatggtttggctactgttgctaa

SEQ ID NO: 21621 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21622 - DNA, 360 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21623 - DNA, 360 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgctccagttatgttggaccgaatgttgcgtctcttggcttgttacaatttcctcccttgttcagttcgtactcaacaagatggaaaggttcagtgactttatggtttggctactgatgctaa

SEQ ID NO: 21624 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21625 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21626 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21627 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaagattcagagcctttatggtttggctactgttgctaa

SEQ ID NO: 21628 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21629 - DNA, 350 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21630 - DNA, 356 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21631 - DNA, 339 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21632 - DNA, 312 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21633 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 21634 - DNA, 362 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21635 - DNA, 352 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21636 - DNA, 360 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21637 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 21638 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21639 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21640 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagcctttatggtttggctactgttgctaa

SEQ ID NO: 21641 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21642 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21643 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21644 - DNA, 357 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21645 - DNA, 357 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 21646 - DNA, 357 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtcctcaaatttcacctattgaaattgcttctcagctcccaacaactaaccctgatgcaccagttatgttggaccgaatgttgcgtcacttggcttgttacaatatcctcacttgttcagttcgtactcaacaagatggaaaggttcagagcctttatggtttggctactgttgctaa

SEQ ID NO: 21647 - DNA, 353 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21648 - DNA, 351 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 21649 - DNA, 352 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21650 - DNA, 349 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttctcctattgaaattgcttctcagctcccaacaactaaccctgatgcaccagttatgttggaccgaatgttgcgtatcttggctttttacaatatcatcacttgttcagttcgtactcaacaagatggaaagattaagagaatttatggtttggctactgttgcta

SEQ ID NO: 21651 - DNA, 352 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21652 - DNA, 302 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagctcccaacaactaaccctgatgcaccagttatgttggaccgaatgttgcgtctcttgacttgttacaatatcctcacttgttcagttcgtactcaacaagatggaaagtttcagagactttatggtttggctactgttgctaa

SEQ ID NO: 21653 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagtaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21654 - DNA, 354 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagctagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21655 - DNA, 362 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaactcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21656 - DNA, 344 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21657 - DNA, 357 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21658 - DNA, 353 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21659 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21660 - DNA, 357 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21661 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21662 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21663 - DNA, 354 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21664 - DNA, 354 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21665 - DNA, 360 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21666 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttcctaa

SEQ ID NO: 21667 - DNA, 360 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21668 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21669 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21670 - DNA, 363 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21671 - DNA, 362 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21672 - DNA, 363 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21673 - DNA, 362 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21674 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21675 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21676 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21677 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21678 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21679 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 21680 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21681 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21682 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggacagaatgttgcgtctcttggcttgttacaatatcctcacttgttcagttcgtactcaacaagatggaaaggttcagagactttatggtttggctactgttgctaa

SEQ ID NO: 21683 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagacttaatggtgtggctactgttgctaa

SEQ ID NO: 21684 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcgaatttctcctattgaaattgcttctcagctcccaacaactaaccctgatgcaccagttatgttggaccgaatgttgcgtctcttggcttgttacaatatcctcacttgttcagttcgtactcaacaagatagaaaggttcagagactttatggtttggcgactggtgctaa

SEQ ID NO: 21685 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21686 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccatttatgttggaccgaatgttgcgtctcttggcttgttacaatatcctcacttgttcagttcgtactcaacaagatggaaaggttcagagactttatggtttggctactgttgctaa

SEQ ID NO: 21687 - DNA, 355 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21688 - DNA, 354 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21689 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21690 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21691 - DNA, 356 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21692 - DNA, 361 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatatcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21693 - DNA, 349 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagtaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21694 - DNA, 336 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21695 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21696 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21697 - DNA, 357 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 21698 - DNA, 323 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21699 - DNA, 359 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaataaagctggacctggtgctcaaatttcacctattgaaatttcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21700 - DNA, 356 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgcaaatagcaagtgcttcagttcttcccatgattttgaaatcagctattgaacttgatctcttagaaaagctggaactggtgctcaaatttcacctattgaaattgcttctcagctaccatcaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21701 - DNA, 363 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatgaaattagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 21702 - DNA, 350 bp, Artificial
  MsCOMT deletion introduced by TALEN pair MsCOMT_T02.1
tctcacaaaaaactcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21703 - DNA, 358 bp, Artificial
  MsCOMT deletion introduced by TALEN pair MsCOMT_T02.1
tctcacaaaaaactcatcaatcacaaccatgggttcaacaggtgaaactcaaataacaccaacccacatataagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21704 - DNA, 356 bp, Artificial
  MsCOMT deletion introduced by TALEN pair MsCOMT_T02.1
tctcacaaaaaactcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatttcttagaaaagctggacctggtgctcaaatttcacctattgaaattgcttctcagctctcaacaactaaccctgatgcaccagttatgttggaccgaatgttgcgtctcttgtcttgttacaatatcctcacttgttcagttcgtactcaacaatatggaaagattcagagactttatggtttgtctactgttgctat

SEQ ID NO: 21705 - DNA, 356 bp, Artificial
  MsCOMT deletion introduced by TALEN pair MsCOMT_T02.1
tctcacaaaaaactcatcaatcacaaccatgggttcaacaggtgaaactcaaataacaccaacccacagataagaagaagaagcaaacctcttcgccatgcaactagcaagtgcttcagttcttcccatgattttgaaatcagctcttgaacttgatctcttagaaaagctggacctggtgctcaaatttcacctattttaattgcttctcagcttcctccaactaaccctgatgcaccagttatgttggaccgattgttgcgtctcttttctttttacaatctcctccctttttctgttcgtactcaacaagatggaaagattcagtgcctttatggtttggctactgttgctaa

SEQ ID NO: 21706 - DNA, 360 bp, Artificial
  MsCOMT deletion introduced by TALEN pair MsCOMT_T02.1
tctcacaaaaaactcatcaatcacaaccatgggttcaacaggtgaaactcaaataacaacaacccacatatcagatgaagaagcaaacctcttcgccatgcaattagcaagtgcttcagttcttcccatgattttaaaataagttattgaacttgatctcttagaaatcaaagctggacctggtgctcaaatttcacatgttcaaattgcttctcagcttccaaccactaaccctgatgcatcagtcattttggaccgaatgttgcgtcacttggcttgttacaatatcctcacttgttctgttcgtactcaacaagatggaaaggttcagagactttatggtttggctactgttgctaa

SEQ ID NO: 21707 - DNA, 350 bp, Artificial
  MsCOMT deletion introduced by TALEN pair MsCOMT_T02.1
tctcacaaaaaactcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactaaacaagatggaaagattcagagactttatggtttggctactgtggctaa

SEQ ID NO: 21708 - DNA, 358 bp, Artificial
  MsCOMT deletion introduced by TALEN pair MsCOMT_T02.1
tctcacaaaaaactcatcaatcacaacaatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctccaatttcccctattgtaattgcttctcagctaccaacaactaaccctgttgcaccagttatgttgaaccgaatgttgcgtctcttggcttgttacaatatcctcccttgttcagttcgtactcaacaagatgtaaacgttcagagcctttctggtttggctactgtcgctaa

SEQ ID NO: 21709 - DNA, 354 bp, Artificial
  MsCOMT deletion introduced by TALEN pair MsCOMT_T02.1
tctcacaaaaaactcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgtttcgtctcttggcttgttacaatatcctcacttgttctgttcgtactcaacaagatggaaaggttcagagactttatggtttggctactgttgctaa

SEQ ID NO: 21710 - DNA, 359 bp, Artificial
  MsCOMT deletion introduced by TALEN pair MsCOMT_T02.1
tctcacaaaaaactatcaatcacaaccatgggttcaacaggtgaaactcaaataacaccaacccacatatcagatgaagaagcaaacctcttcgccatgcaattagcaattgattcagttcttcccatgagtttaaaatcagctcttgaacgtgatctcttagaaattaaagctggacctggttcgcaaatttcacctattgaaattgcttctcagctcccaacaactaaccctgatgcaacagttattttggaccgaatgttgcgtctcttggcttgttacaatatcctcacttgttcagttcgtactcaacaagatggaaagattcagagactttatggtttggctactgttgctaa

SEQ ID NO: 21711 - DNA, 361 bp, Artificial
  MsCOMT deletion introduced by TALEN pair MsCOMT_T02.1
tctcacaaaaaacctcttcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21712 - DNA, 360 bp, Artificial
  MsCOMT deletion introduced by TALEN pair MsCOMT_T02.1
tctcacaaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21713 - DNA, 223 bp, Artificial
  MsCOMT deletion introduced by TALEN pair MsCOMT_T02.1
tctcacaaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaagaagatggaaagattcagagactttatggtttggctactgttgctaa

SEQ ID NO: 21714 - DNA, 361 bp, Artificial
  MsCOMT deletion introduced by TALEN pair MsCOMT_T02.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21715 - DNA, 357 bp, Artificial
  MsCOMT deletion introduced by TALEN pair MsCOMT_T02.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21716 - DNA, 357 bp, Artificial
  MsCOMT deletion introduced by TALEN pair MsCOMT_T02.1
tctcacaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21717 - DNA, 355 bp, Artificial
  MsCOMT deletion introduced by TALEN pair MsCOMT_T02.1
tctcacaaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21718 - DNA, 356 bp, Artificial
  MsCOMT deletion introduced by TALEN pair MsCOMT_T02.1
tctcaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21719 - DNA, 358 bp, Artificial
  MsCOMT deletion introduced by TALEN pair MsCOMT_T02.1
tctcaacaaaaacctcatcaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagataaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21720 - DNA, 361 bp, Artificial
  MsCOMT deletion introduced by TALEN pair MsCOMT_T02.1
tctcaacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21721 - DNA, 361 bp, Artificial
  MsCOMT deletion introduced by TALEN pair MsCOMT_T02.1
tctcaacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21722 - DNA, 352 bp, Artificial
  MsCOMT deletion introduced by TALEN pair MsCOMT_T02.1
tctcaaacctcatcaatcacaaccatgggttcaacaggtgaacctcaaataaccccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21723 - DNA, 355 bp, Artificial
  MsCOMT deletion introduced by TALEN pair MsCOMT_T02.1
tctcaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcagcacttgaaattgcttctcagctaccaacaactaaccctgatgcaccagttatgttggaccgaatgttgcgtctcttggcttgttacaatatcctcacttgttcagttcgtactcaacaagatggaaagcttcagagactttatggtttggctactgttgctaa

SEQ ID NO: 21724 - DNA, 356 bp, Artificial
  MsCOMT deletion introduced by TALEN pair MsCOMT_T02.1
tctcaaaaactcatcaatcacaaccatgggttcaacaggtgacactcaaataacaccaacccacatatcatatgaagaagcacacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21725 - DNA, 358 bp, Artificial
  MsCOMT deletion introduced by TALEN pair MsCOMT_T02.1
tctcaaaaacctcatcaatcacaaccatgggttcaactggtgcaactcaaataccaccaacccacatatcagatgaagaagcaaacctcttcgccattcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21726 - DNA, 356 bp, Artificial
  MsCOMT deletion introduced by TALEN pair MsCOMT_T02.1
tctcaaaaacctcatcaatcacaaccatgggttcaacaggtgcaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21727 - DNA, 357 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagccaacctcttcgccattcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21728 - DNA, 353 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagccaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21729 - DNA, 245 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacaatatcctcacttgttctgttcgtactcaacaagatggaaaggttcagagactttatggtttggctactgttgctaa

SEQ ID NO: 21730 - DNA, 357 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21731 - DNA, 356 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21732 - DNA, 357 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21733 - DNA, 355 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21734 - DNA, 355 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21735 - DNA, 285 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21736 - DNA, 352 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21737 - DNA, 358 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21738 - DNA, 359 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21739 - DNA, 361 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21740 - DNA, 357 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21741 - DNA, 353 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21742 - DNA, 354 bp, Artificial
  MsCOMT deletion introduced by TALEN pair MsCOMT_T02.1
tctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21743 - DNA, 354 bp, Artificial
  MsCOMT deletion introduced by TALEN pair MsCOMT_T02.1
tctcaaaaaactcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21744 - DNA, 354 bp, Artificial
  MsCOMT deletion introduced by TALEN pair MsCOMT_T02.1
tctcaaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21745 - DNA, 353 bp, Artificial
  MsCOMT deletion introduced by TALEN pair MsCOMT_T02.1
tctcaaaaaacctcctcaatcacaaccattggttcaacaggtgaaactcaaatcacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21746 - DNA, 359 bp, Artificial
  MsCOMT deletion introduced by TALEN pair MsCOMT_T02.1
tctcaaaaaacctcctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 21747 - DNA, 353 bp, Artificial
  MsCOMT deletion introduced by TALEN pair MsCOMT_T02.1
tctcaaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21748 - DNA, 358 bp, Artificial
  MsCOMT deletion introduced by TALEN pair MsCOMT_T02.1
tctcaaaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21749 - DNA, 359 bp, Artificial
  MsCOMT deletion introduced by TALEN pair MsCOMT_T02.1
tctcaaaaaacctcatcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21750 - DNA, 351 bp, Artificial
  MsCOMT deletion introduced by TALEN pair MsCOMT_T02.1
tctcaaaaaacctcatcaatcacaaccatgggttcaacaggtgaaactcaaatcacaccaacccacatatcagatgaagaagcaaacctcttcgccattcaactagcaagtgcttcagttcttcccatgattttgaaatcagctcttgaacttgatctcttaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21751 - DNA, 359 bp, Artificial
  MsCOMT deletion introduced by TALEN pair MsCOMT_T02.1
tctcaaaaaacctcatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21752 - DNA, 357 bp, Artificial
  MsCOMT deletion introduced by TALEN pair MsCOMT_T02.1
tctcaaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21753 - DNA, 351 bp, Artificial
  MsCOMT deletion introduced by TALEN pair MsCOMT_T02.1
tctcaaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttaagctgtacctggtgctcaaatttcacctattgaaattgcttctcagctaccaacaactaaccctgatgcaccagttatgttggaccgaatgtttcgtctcttggcttgttacaatatcctcacttgttcagttcgtactcaacaagatggaaagattcagagcctttatggtttggctactgttactaa

SEQ ID NO: 21754 - DNA, 344 bp, Artificial
  MsCOMT deletion introduced by TALEN pair MsCOMT_T02.1
tctcaaaaaacctcatcaatcacaaccatgggttcaacaggtgaaactcaaatcacaccaacccacatatcagatgaagaaacaaacctcttcgccatgcaactagcaagtgcttcagttcttcccatgattttgaaatcagctcttgaacttgatctcttagaaggtgctcaaatttcacctattgaaattgctactcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21755 - DNA, 352 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21756 - DNA, 349 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21757 - DNA, 301 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagttcttcagttcttcccatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21758 - DNA, 357 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21759 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21760 - DNA, 345 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21761 - DNA, 351 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21762 - DNA, 360 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21763 - DNA, 353 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21764 - DNA, 358 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgtaacaatatcctcacttgttcagttcgtactcaacaagctggaaaggttcagagactttatggtttggctactgttgcta

SEQ ID NO: 21765 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21766 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21767 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21768 - DNA, 360 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21769 - DNA, 360 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21770 - DNA, 355 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21771 - DNA, 338 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttggtacaatatcctcacttgttcagttcgtactcaacaagatggaaaggttcagagactttatggtttggctactggtgctaa

SEQ ID NO: 21772 - DNA, 360 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21773 - DNA, 350 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21774 - DNA, 357 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21775 - DNA, 357 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21776 - DNA, 357 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21777 - DNA, 358 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21778 - DNA, 356 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21779 - DNA, 352 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21780 - DNA, 352 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21781 - DNA, 351 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21782 - DNA, 286 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21783 - DNA, 341 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcatctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21784 - DNA, 350 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21785 - DNA, 356 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21786 - DNA, 357 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttgtcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21787 - DNA, 353 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21788 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21789 - DNA, 360 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21790 - DNA, 360 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21791 - DNA, 364 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21792 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21793 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21794 - DNA, 357 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21795 - DNA, 358 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21796 - DNA, 358 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21797 - DNA, 359 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21798 - DNA, 355 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21799 - DNA, 357 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21800 - DNA, 351 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggaccaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21801 - DNA, 352 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21802 - DNA, 345 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21803 - DNA, 360 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21804 - DNA, 420 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcgttggtagctcttgatccggcaaacaaaccaccgctggtagcggtggtttttttgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21805 - DNA, 358 bp, Artificial
  MsCOMT deletion introduced by TALEN pair MsCOMT_T02.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21806 - DNA, 356 bp, Artificial
  MsCOMT deletion introduced by TALEN pair MsCOMT_T02.1
tctcaaaaaaacctcatcaatcacaaccatgggttcaacaggtgaaactcaaataacaccaacccacatatcagatgaagaagcaaacctctacgccatgcaattagcaagtgcttcagttcttcccatgattttaaaatcagctcttgaacttgatctcttagaaaagctgtacctggtgctcaaatttcacctgttcaaattgcttgtcagcttccaacaactaacgctgatgcaccagtcattttggaccgaatgttgtgtctcttggcttgttacaatatcctcaattgttctgttcgtagtcaagaagatggaaaggttcagagactttatggtttggctactgttgctaa

SEQ ID NO: 21807 - DNA, 355 bp, Artificial
  MsCOMT deletion introduced by TALEN pair MsCOMT_T02.1
tctacctcatcaatcacaaccatgggttcaacaggtgaaactcaaataacacccacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21808 - DNA, 356 bp, Artificial
  MsCOMT deletion introduced by TALEN pair MsCOMT_T02.1
tctacaaacctcatcaatcacaaccatggtttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21809 - DNA, 358 bp, Artificial
  MsCOMT deletion introduced by TALEN pair MsCOMT_T02.1
tctacaaaacctcatcaatcacaaccatgggttcaacaggtgaaactcacataacaccaacccacatatcagatgaagaagcaaacctcttagccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21810 - DNA, 358 bp, Artificial
  MsCOMT deletion introduced by TALEN pair MsCOMT_T02.1
tctacaaaaacctctcaatcacaaccatgggttcaacaggtgcaactcaaataccaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21811 - DNA, 351 bp, Artificial
  MsCOMT deletion introduced by TALEN pair MsCOMT_T02.1
tctacaaaaacctcctcaatcacaaccattggttcaacaggtgaaactccaataacaccaacccacatatcagatgaagaagcaaacctcttcgccattcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21812 - DNA, 357 bp, Artificial
  MsCOMT deletion introduced by TALEN pair MsCOMT_T02.1
tctacaaaaacctcctcaatcacaaccatgggttcaacaggtgaaactcaaataacaccaacccacatatcagatgaagaagcaaacttcttcgccattcaattagcaagtgcttcagttcttcccatgattttaaaatcagctcttgaacttgatctcttataaatcatctggacctgttgctcatatttcacctattgcaattgcttctcagctcccaacaactaaccctgatgcaccagttatgttggtccgaatgttgcgtctcttggcttgttacaatatcctcacttgttcagttcgtcctcaacaagatggaaagattcagagactttatggtttggctactgtagcaaa

SEQ ID NO: 21813 - DNA, 350 bp, Artificial
  MsCOMT deletion introduced by TALEN pair MsCOMT_T02.1
tctacaaaaacctcctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21814 - DNA, 359 bp, Artificial
  MsCOMT deletion introduced by TALEN pair MsCOMT_T02.1
tctacaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21815 - DNA, 355 bp, Artificial
  MsCOMT deletion introduced by TALEN pair MsCOMT_T02.1
tctacaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21816 - DNA, 356 bp, Artificial
  MsCOMT deletion introduced by TALEN pair MsCOMT_T02.1
tctacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21817 - DNA, 354 bp, Artificial
  MsCOMT deletion introduced by TALEN pair MsCOMT_T02.1
tctacaaaaacctcatcatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21818 - DNA, 354 bp, Artificial
  MsCOMT deletion introduced by TALEN pair MsCOMT_T02.1
tctacaaaaacctcatcaatcacaaccattggttcaacaggtgaaactccaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21819 - DNA, 349 bp, Artificial
  MsCOMT deletion introduced by TALEN pair MsCOMT_T02.1
tctacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 21820 - DNA, 358 bp, Artificial
  MsCOMT deletion introduced by TALEN pair MsCOMT_T02.1
tctacaaaaacctcatcaatcacaaccatgggttcgacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21821 - DNA, 359 bp, Artificial
  MsCOMT deletion introduced by TALEN pair MsCOMT_T02.1
tctacaaaaacctcatcaatcacaaccatgggttcaacaggtgaaactcgaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21822 - DNA, 351 bp, Artificial
  MsCOMT deletion introduced by TALEN pair MsCOMT_T02.1
tctacaaaaacctcatcaatcacaaccatgggttcaacaggtgaaactcaaatcataccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21823 - DNA, 359 bp, Artificial
  MsCOMT deletion introduced by TALEN pair MsCOMT_T02.1
tctacaaaaacctcatcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21824 - DNA, 352 bp, Artificial
  MsCOMT deletion introduced by TALEN pair MsCOMT_T02.1
tctacaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21825 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21826 - DNA, 413 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21827 - DNA, 353 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 21828 - DNA, 350 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21829 - DNA, 359 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21830 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21831 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21832 - DNA, 359 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21833 - DNA, 359 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21834 - DNA, 361 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21835 - DNA, 357 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21836 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21837 - DNA, 358 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21838 - DNA, 358 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgcttaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21839 - DNA, 358 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21840 - DNA, 355 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 21841 - DNA, 259 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 21842 - DNA, 361 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactttatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactaaacaagatggaaagattcagagaatttatgggctggataatgttgctaa

SEQ ID NO: 21843 - DNA, 356 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21844 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21845 - DNA, 361 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21846 - DNA, 357 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21847 - DNA, 358 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21848 - DNA, 358 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21849 - DNA, 358 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21850 - DNA, 354 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21851 - DNA, 343 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 21852 - DNA, 345 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21853 - DNA, 348 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21854 - DNA, 345 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21855 - DNA, 362 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 21856 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21857 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21858 - DNA, 357 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21859 - DNA, 356 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcttcgccatgcaactagcaagagcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21860 - DNA, 360 bp, Artificial
  MsCOMT deletion introduced by TALEN pair MsCOMT_T02.1
tctacaaaaacctcatcaatcacaaccatgggttcaacaggtgaaactcaaataacaccaacccacatatcagatgaagaagcaaacctcgtcgccatgcaattagcaagtgcttcagttcttcccatgattttaaaatcagctcttaaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21861 - DNA, 351 bp, Artificial
  MsCOMT deletion introduced by TALEN pair MsCOMT_T02.1
tctacaaaaacctcatcaatcacaaccatgggttcaacaggcgaaactcaaataacaccaacccacatatcagatgaagaagcaaacctcttcgccattcaactagcaagtgcttcagttcttcccatgattttgaaatcatctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21862 - DNA, 353 bp, Artificial
  MsCOMT deletion introduced by TALEN pair MsCOMT_T02.1
tctacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21863 - DNA, 353 bp, Artificial
  MsCOMT deletion introduced by TALEN pair MsCOMT_T02.1
tctacaaaaacctcataatcacaaccatgggttcaacaggtgaaactcaaataacaccaacccacatatcagatgaagaagcaaacctcttcgccatgcaaccagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21864 - DNA, 304 bp, Artificial
  MsCOMT deletion introduced by TALEN pair MsCOMT_T02.1
tctacaaaaacatcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21865 - DNA, 358 bp, Artificial
  MsCOMT deletion introduced by TALEN pair MsCOMT_T02.1
tctaacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21866 - DNA, 360 bp, Artificial
  MsCOMT deletion introduced by TALEN pair MsCOMT_T02.1
tctaacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaatttcttatcagctaccaacaactaaccctgatgcaccagttatgttggaccgaatgttgcgtctcttggcttgttacaatatcctcacttgttcagttcgtactcaacaagatggaaagattcagagactttatggtttggctaatgttgataa

SEQ ID NO: 21867 - DNA, 360 bp, Artificial
  MsCOMT deletion introduced by TALEN pair MsCOMT_T02.1
tctaacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21868 - DNA, 359 bp, Artificial
  MsCOMT deletion introduced by TALEN pair MsCOMT_T02.1
tctaacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21869 - DNA, 356 bp, Artificial
  MsCOMT deletion introduced by TALEN pair MsCOMT_T02.1
tctaacaaaaacctcatcaatcacaaccatgggttcaacaggtgaaactaaaataacaccaacccacatatcagatgaagaagcaaacctcttcgccatgaaattagcaagtgcttcagttcttaccatgattttgaaatcagctcttgaacttgatctcttagaaaagctcgaccttgttctcaaattttacctattgaaattgcttctcagctcacaacaactaaccctgatacaacagttatgttggaccgaatgttgcgtctcttggcttgttacaatatcctcacttgtgcagttcgtactcaacaagacggaaaagttcagagactttatggtttggctactggtgataa

SEQ ID NO: 21870 - DNA, 352 bp, Artificial
  MsCOMT deletion introduced by TALEN pair MsCOMT_T02.1
tctaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 21871 - DNA, 358 bp, Artificial
  MsCOMT deletion introduced by TALEN pair MsCOMT_T02.1
tctaaaaacctcatcaatcacaaccatgggttcaacaggtgacactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21872 - DNA, 355 bp, Artificial
  MsCOMT deletion introduced by TALEN pair MsCOMT_T02.1
tctaaaaacctcatcaatcacaaccatgggttcaacaggtgaaactcaaataacaccaacccacatatcagatgaagaagcacacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 21873 - DNA, 359 bp, Artificial
  MsCOMT deletion introduced by TALEN pair MsCOMT_T02.1
tctaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21874 - DNA, 361 bp, Artificial
  MsCOMT deletion introduced by TALEN pair MsCOMT_T02.1
tcgcacaaaaacctcatcaatcgcagccaggggttcaacaggtgaaactcaaataacaccaacccacatatcagatgaagaggcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21875 - DNA, 361 bp, Artificial
  MsCOMT deletion introduced by TALEN pair MsCOMT_T02.1
tcgcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21876 - DNA, 358 bp, Artificial
  MsCOMT deletion introduced by TALEN pair MsCOMT_T02.1
tcgcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21877 - DNA, 361 bp, Artificial
  MsCOMT deletion introduced by TALEN pair MsCOMT_T02.1
tcctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21878 - DNA, 347 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcacttagcaagtgcttcagttcttcccatgattttaaaatcagctcttgaacttgatctcttggacctggtgctcaagtttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21879 - DNA, 358 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21880 - DNA, 355 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21881 - DNA, 361 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21882 - DNA, 358 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21883 - DNA, 359 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21884 - DNA, 355 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttctgagactttatggtttggctactgttgctaa

SEQ ID NO: 21885 - DNA, 355 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21886 - DNA, 356 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 21887 - DNA, 360 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21888 - DNA, 361 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21889 - DNA, 361 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21890 - DNA, 360 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21891 - DNA, 353 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21892 - DNA, 360 bp, Artificial
  MsCOMT deletion introduced by TALEN pair MsCOMT_T02.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21893 - DNA, 360 bp, Artificial
  MsCOMT deletion introduced by TALEN pair MsCOMT_T02.1
tccacaaacacatcctccctcacaaccatgggttcaacaggttaaactcaaataacaccaacccacatatcagatgaataatcaaacctcttcgccatgcaattagcaagtgcttcagttcttcccatgattttaaaatcatctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21894 - DNA, 357 bp, Artificial
  MsCOMT deletion introduced by TALEN pair MsCOMT_T02.1
tccacaaaacctcatcaatcacaaccatgggttcaacaggtgcaactcacataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21895 - DNA, 343 bp, Artificial
  MsCOMT deletion introduced by TALEN pair MsCOMT_T02.1
tccacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21896 - DNA, 221 bp, Artificial
  MsCOMT deletion introduced by TALEN pair MsCOMT_T02.1
tccacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21897 - DNA, 360 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21898 - DNA, 357 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21899 - DNA, 343 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21900 - DNA, 364 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21901 - DNA, 360 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21902 - DNA, 360 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21903 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctcccaacaactaaccctgatgcaccagttatgttggaccgaatgtggcgtctctgggcttgttacaatatcctcacttgttcagttcgtactcaacaagatggaaagattcagagactttatggtttggctactgttgctaa

SEQ ID NO: 21904 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaagattcagagactttatggtttggctactgttgctaa

SEQ ID NO: 21905 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21906 - DNA, 354 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21907 - DNA, 354 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21908 - DNA, 355 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcatctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21909 - DNA, 360 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21910 - DNA, 361 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21911 - DNA, 362 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21912 - DNA, 359 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21913 - DNA, 360 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21914 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21915 - DNA, 359 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21916 - DNA, 356 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21917 - DNA, 356 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21918 - DNA, 343 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21919 - DNA, 305 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21920 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21921 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21922 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21923 - DNA, 358 bp, Artificial
  MsCOMT deletion introduced by TALEN pair MsCOMT_T02.1
tccacaaaaacctcatcaatcacaaccatgggttcaacaggtgaaactcaaataacaccaacccacataccagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21924 - DNA, 358 bp, Artificial
  MsCOMT deletion introduced by TALEN pair MsCOMT_T02.1
tcacacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21925 - DNA, 350 bp, Artificial
  MsCOMT deletion introduced by TALEN pair MsCOMT_T02.1
tcacacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21926 - DNA, 359 bp, Artificial
  MsCOMT deletion introduced by TALEN pair MsCOMT_T02.1
tcacacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21927 - DNA, 358 bp, Artificial
  MsCOMT deletion introduced by TALEN pair MsCOMT_T02.1
tcacacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21928 - DNA, 359 bp, Artificial
  MsCOMT deletion introduced by TALEN pair MsCOMT_T02.1
tcacaaaaacctcatcaatcacaaccatgggttcaacaggtgcaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21929 - DNA, 350 bp, Artificial
  MsCOMT deletion introduced by TALEN pair MsCOMT_T02.1
tcacaaaaacctcatcaatcacaaccatgggttcaacaggtgaaactcacataacaccaacccacatatcagatgaagaagccaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21930 - DNA, 349 bp, Artificial
  MsCOMT deletion introduced by TALEN pair MsCOMT_T02.1
tcacaaaaacctcatcaatcacaaccatgggttcaacaggtgaaactcaaataccaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21931 - DNA, 350 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagccaacctcttcgccatgcaattagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21932 - DNA, 354 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21933 - DNA, 436 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacggctttaccccccagcaggtggtggccatcgccagcaagaatggtggcaagcaggcgctggagctaaagctggacctcgtgctcaaatttcacctattgaaattgcttctcagctaccaacatctaaccctgatgcaccagttatgttggaccgaatgttgcatctcttggcttgttacaatatccgcacttgttcagttcgtactcaacaagatggaaaggttcagagactttatggtttggctactgttgctaa

SEQ ID NO: 21934 - DNA, 358 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21935 - DNA, 359 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21936 - DNA, 355 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21937 - DNA, 361 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21938 - DNA, 358 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21939 - DNA, 359 bp, Artificial
  MsCOMT deletion introduced by TALEN pair MsCOMT_T02.1
tcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21940 - DNA, 196 bp, Artificial
  MsCOMT deletion introduced by TALEN pair MsCOMT_T02.1
tcacaaaaacctcatcaatcacaaccatgggttcaacaggtgaaactcaaataacaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21941 - DNA, 357 bp, Artificial
  MsCOMT deletion introduced by TALEN pair MsCOMT_T02.1
tcacaaaaaccacatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21942 - DNA, 348 bp, Artificial
  MsCOMT deletion introduced by TALEN pair MsCOMT_T02.1
tcaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21943 - DNA, 212 bp, Artificial
  MsCOMT deletion introduced by TALEN pair MsCOMT_T02.1
tcaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 21944 - DNA, 350 bp, Artificial
  MsCOMT deletion introduced by TALEN pair MsCOMT_T02.1
tcaaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21945 - DNA, 350 bp, Artificial
  MsCOMT deletion introduced by TALEN pair MsCOMT_T02.1
tcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21946 - DNA, 351 bp, Artificial
  MsCOMT deletion introduced by TALEN pair MsCOMT_T02.1
tatcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21947 - DNA, 343 bp, Artificial
  MsCOMT deletion introduced by TALEN pair MsCOMT_T02.1
tacaaaaactcatcaatcacaaccatgggttcaacaggtgaacctcaaataacaccaacccacatatcagatgaagaagcaaacctcttcgccatgcaattagcaagtgcttcagttcttcccatgattttaaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21948 - DNA, 388 bp, Artificial
  MsCOMT deletion introduced by TALEN pair MsCOMT_T02.1
gtctcacaaaaacctcatcaatcacaaccatgggttcaacaggtgaaactcaactaacaccaacccacatatcagatgaagaagcaaacctcttcgccatgcaattagcaagtgcttcagttcttcccatgattttaaaatcagctcttgaacttgatctcttagaaattccgactgagcctttcgttttatttgctaaagctggacctggtgctcaaatttcacctattgaaattgcttctcagctcccaacaactaaccctgatgccccagttatgttggaccgaatgttgcgtctcttggcttgttacaatatcctcacttgttcagttcgtactcaacaagatggaaagattcagaggctttatggtttggctactgttgctaa

SEQ ID NO: 21949 - DNA, 363 bp, Artificial
  MsCOMT deletion introduced by TALEN pair MsCOMT_T02.1
gtctcacaaaaacctcatcaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21950 - DNA, 361 bp, Artificial
  MsCOMT deletion introduced by TALEN pair MsCOMT_T02.1
gtctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21951 - DNA, 362 bp, Artificial
  MsCOMT deletion introduced by TALEN pair MsCOMT_T02.1
gtctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21952 - DNA, 346 bp, Artificial
  MsCOMT deletion introduced by TALEN pair MsCOMT_T02.1
gtctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 21953 - DNA, 362 bp, Artificial
  MsCOMT deletion introduced by TALEN pair MsCOMT_T02.1
gtctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 21954 - DNA, 359 bp, Artificial
  MsCOMT deletion introduced by TALEN pair MsCOMT_T02.1
gtctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21955 - DNA, 364 bp, Artificial
  MsCOMT deletion introduced by TALEN pair MsCOMT_T02.1
gtctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21956 - DNA, 357 bp, Artificial
  MsCOMT deletion introduced by TALEN pair MsCOMT_T02.1
ggtcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21957 - DNA, 354 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctat

SEQ ID NO: 21958 - DNA, 359 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 21959 - DNA, 353 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21960 - DNA, 360 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 21961 - DNA, 361 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 21962 - DNA, 360 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 21963 - DNA, 355 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 21964 - DNA, 360 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagcttgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 21965 - DNA, 353 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaactagcaagtgcttcagttcttcccatgtttttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctac

SEQ ID NO: 21966 - DNA, 353 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 21967 - DNA, 354 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 21968 - DNA, 359 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 21969 - DNA, 353 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 21970 - DNA, 360 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 21971 - DNA, 357 bp, Artificial
  MsCOMT deletion introduced by TALEN pair MsCOMT_T02.1
gctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 21972 - DNA, 353 bp, Artificial
  MsCOMT deletion introduced by TALEN pair MsCOMT_T02.1
gctcacaaaaacctcatcaatcacaaccatgggttcaacaagtgaaactcaaataacaccaacccacataccccctccagaagcaaacctcttcgccatgcaactagcaagtgcttcagttcttcccatgattttgaaatcagctcttgaacttgatctcttaaagctggacctggtgctcaaatttcacctggtcaaattgcttctcagcttccaccaactaaccctgatgcaccagtcatgttggaccgaatgttgcgtctcttagcttgttacaatatcctcacttgttctgttcgtactcaacaagatggaaagttgcagagactttatggtttggctactgttgctaa

SEQ ID NO: 21973 - DNA, 359 bp, Artificial
  MsCOMT deletion introduced by TALEN pair MsCOMT_T02.1
gctcacaaaaacctcatcaatcaaaaacctgaatacaaaaggtgaaaagcaaaaaacaacacacaacacatcctcttaaaaaacaaacctcttcgccatgcaactagcaagtgcttcagttcttcccatgattttgaaatcagctcttgaacttgatctcttagaaattaagctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 21974 - DNA, 356 bp, Artificial
  MsCOMT deletion introduced by TALEN pair MsCOMT_T02.1
gcgaaaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 21975 - DNA, 322 bp, Artificial
  MsCOMT deletion introduced by TALEN pair MsCOMT_T02.1
gcacacaaaaaactcatcaatcacaaccatgggtgcaaaaggtgaaactcaaataacaccaacccacatatcagatgaagaagcaaacctcttcgccatgcaattagcaagtgcttcagttcttcccatgattttaaaatcagctcttgaacttgatctcttagaaatcatcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21976 - DNA, 341 bp, Artificial
  MsCOMT deletion introduced by TALEN pair MsCOMT_T02.1
gaaaggggaaacctcatcaatcacaaccatgggttcaacaggtgaaactcaaataacaccaacccacatatccgatgaagaagcaaacctcttcgccatgcaactagcaagtgcttcagttcttcccatgattttgaaatcagctcttgaacttctggacctggtgctcaaatttcacctattgaaattgcttctcagctaccaacaactaaccctgatgcaccagttatgttggaccgaatgttgcgtctcttggcttgttacaatatccgcacttgttcagttcgtactcaacaagatggaaagattcagagactttatggtttggctactgttgctaa

SEQ ID NO: 21977 - DNA, 354 bp, Artificial
  MsCOMT deletion introduced by TALEN pair MsCOMT_T02.1
gaaaaaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 21978 - DNA, 363 bp, Artificial
  MsCOMT deletion introduced by TALEN pair MsCOMT_T02.1
gaaaaaaaaaacctcatcaatcacaaacatgggttcaacaggtgaaactcaaataacaccaacccacatatcagatgaagaagcaaacctcttcgccatgcaaacagcaagtgcttcagttcttcccatgattttaaaatcagctcttgaacttgatcacttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacatgatggaaaagttcagagcctttatggtttggctactgttgctta

SEQ ID NO: 21979 - DNA, 352 bp, Artificial
  MsCOMT deletion introduced by TALEN pair MsCOMT_T02.1
gaaaaaaaaaacatcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21980 - DNA, 343 bp, Artificial
  MsCOMT deletion introduced by TALEN pair MsCOMT_T02.1
ctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21981 - DNA, 337 bp, Artificial
  MsCOMT deletion introduced by TALEN pair MsCOMT_T02.1
ctcacaaaaacctcatcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21982 - DNA, 358 bp, Artificial
  MsCOMT deletion introduced by TALEN pair MsCOMT_T02.1
ctcacaaaaacctcatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 21983 - DNA, 358 bp, Artificial
  MsCOMT deletion introduced by TALEN pair MsCOMT_T02.1
ctcacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21984 - DNA, 352 bp, Artificial
  MsCOMT deletion introduced by TALEN pair MsCOMT_T02.1
ctcacaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21985 - DNA, 357 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcatctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21986 - DNA, 350 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21987 - DNA, 360 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21988 - DNA, 356 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21989 - DNA, 358 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcatctcttgaacttgatctcttagaaatccagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21990 - DNA, 336 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctcccaacaactaaccctgatgcaccagttatgttggaccgaatgttgcgtctcttggcttgttacaatatcctcacttgttcagttcgtacacaacaagatggaaagattcagagactttatggtttggctactgttgctaa

SEQ ID NO: 21991 - DNA, 338 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21992 - DNA, 357 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21993 - DNA, 357 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 21994 - DNA, 360 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 21995 - DNA, 361 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 21996 - DNA, 358 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21997 - DNA, 358 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21998 - DNA, 354 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 21999 - DNA, 355 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22000 - DNA, 349 bp, Artificial
  MsCOMT deletion introduced by TALEN pair MsCOMT_T02.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22001 - DNA, 197 bp, Artificial
  MsCOMT deletion introduced by TALEN pair MsCOMT_T02.1
ctcacaaaaacctcatcaatcacaaccatgggttcaacaggtgaaactcaaataacaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22002 - DNA, 353 bp, Artificial
  MsCOMT deletion introduced by TALEN pair MsCOMT_T02.1
ctcaaaaaacctcatcaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22003 - DNA, 345 bp, Artificial
  MsCOMT deletion introduced by TALEN pair MsCOMT_T02.1
ctcaaaaaacctcatcaatcacaaccatgggttcaacaggtgaaactcaaataacaccaacccacatatcagatgaagaagccaacctcttcgccatgcaattagcaagtgcttcagttcttcccatgattttgaaatcagctcttgaacttgatctcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22004 - DNA, 347 bp, Artificial
  MsCOMT deletion introduced by TALEN pair MsCOMT_T02.1
cctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22005 - DNA, 358 bp, Artificial
  MsCOMT deletion introduced by TALEN pair MsCOMT_T02.1
cctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22006 - DNA, 222 bp, Artificial
  MsCOMT deletion introduced by TALEN pair MsCOMT_T02.1
cctcacaaaaacctcatcaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22007 - DNA, 351 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22008 - DNA, 360 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaagattcagagactttatggtttggctactgttgctag

SEQ ID NO: 22009 - DNA, 355 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22010 - DNA, 358 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22011 - DNA, 363 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22012 - DNA, 359 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22013 - DNA, 359 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgctcctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22014 - DNA, 356 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22015 - DNA, 353 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22016 - DNA, 354 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcctactcaacaagatggaaagattcagagactttatggtttggctactgttgctaa

SEQ ID NO: 22017 - DNA, 360 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattggaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggagactgttgctaa

SEQ ID NO: 22018 - DNA, 361 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22019 - DNA, 402 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataatgctctccagcgccggcctgccgccgccattgctggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22020 - DNA, 359 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22021 - DNA, 339 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagctaccaacaactaaccctgatgcaccagttatgttggaccgcatgttgcgtctcttggcttgttacaatatcctcacttgttcagttcgtactcaacaagatggaaaggttcagagactttatggtttggctactgttgctaa

SEQ ID NO: 22022 - DNA, 358 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22023 - DNA, 360 bp, Artificial
  MsCOMT deletion introduced by TALEN pair MsCOMT_T02.1
cctcacaaaaacctcatcaatcacaaccatgggttcaacaggtgaaactcaaataacaccaacccacatatcagatgaagaagcaaacctcttcaccatgcaattagcaagtgcttcagttcttcccatgattttgaaatcagctcttgaacttgatctcttagaaatcaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22024 - DNA, 358 bp, Artificial
  MsCOMT deletion introduced by TALEN pair MsCOMT_T02.1
ccacaaaaacctcatcaatcacaaccatgtgttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22025 - DNA, 356 bp, Artificial
  MsCOMT deletion introduced by TALEN pair MsCOMT_T02.1
ccaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22026 - DNA, 332 bp, Artificial
  MsCOMT deletion introduced by TALEN pair MsCOMT_T02.1
cacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22027 - DNA, 357 bp, Artificial
  MsCOMT deletion introduced by TALEN pair MsCOMT_T02.1
cacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22028 - DNA, 349 bp, Artificial
  MsCOMT deletion introduced by TALEN pair MsCOMT_T02.1
cacaaaaacctcatcaatcacaaccatgggttcaacagatgaaactcaaataacaccaacccacatatcggatgaagaagcaaacctcttcgccatgcaattagcaagtgcttcagttcttcccatgattttaaaatcagctcttgaacttgatctcttagaaatgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22029 - DNA, 354 bp, Artificial
  MsCOMT deletion introduced by TALEN pair MsCOMT_T02.1
actcacaaaaacctcatcaatcacaaccatgggttcaacaggtgaaactcaaataacaccaacccacgtatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22030 - DNA, 398 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcggctgttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22031 - DNA, 360 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctat

SEQ ID NO: 22032 - DNA, 361 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22033 - DNA, 353 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22034 - DNA, 351 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaagttgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22035 - DNA, 358 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 22036 - DNA, 356 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 22037 - DNA, 353 bp, Artificial
  MsCOMT deletion introduced by TALEN pair MsCOMT_T02.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 22038 - DNA, 349 bp, Artificial
  MsCOMT deletion introduced by TALEN pair MsCOMT_T02.1
acaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22039 - DNA, 350 bp, Artificial
  MsCOMT deletion introduced by TALEN pair MsCOMT_T02.1
aaacctcatcaatcacaaccattggttcaacaggtgaaactcaaataacaccaacccacatatcagatgaagaagcaaacctcttcgccctgcaactagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaagattcagagactttatggtttggctactgttgctaaa

SEQ ID NO: 22040 - DNA, 351 bp, Artificial
  MsCOMT deletion introduced by TALEN pair MsCOMT_T02.1
aaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22041 - DNA, 353 bp, Artificial
  MsCOMT deletion introduced by TALEN pair MsCOMT_T02.1
aaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaactcgatctcttagaaataaagctggacctggtgctcaaatttcacctattgaaattgcttctcagctcccaacaactaaccctgatgcaccagttatgttggaccgaatgttgcgactcttggcttgttacaatatcctcacttgttcagttcgtactcaacaagatggaaagattcagagactttatggtttggctactgttgctaa

SEQ ID NO: 22042 - DNA, 359 bp, Artificial
  MsCOMT deletion introduced by TALEN pair MsCOMT_T02.1
aaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22043 - DNA, 365 bp, Artificial
  MsCOMT deletion introduced by TALEN pair MsCOMT_T03.1
tttcacaaaaacctcatcaatcacaaccatgggttcaacaggtgaaactcaaataacaccaatccacatatcagatgaagaagcaaacctcttcgccatgcaactagcaagtgcatcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22044 - DNA, 365 bp, Artificial
  MsCOMT deletion introduced by TALEN pair MsCOMT_T03.1
tttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22045 - DNA, 360 bp, Artificial
  MsCOMT deletion introduced by TALEN pair MsCOMT_T03.1
tttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22046 - DNA, 361 bp, Artificial
  MsCOMT deletion introduced by TALEN pair MsCOMT_T03.1
tttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22047 - DNA, 356 bp, Artificial
  MsCOMT deletion introduced by TALEN pair MsCOMT_T03.1
tttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22048 - DNA, 355 bp, Artificial
  MsCOMT deletion introduced by TALEN pair MsCOMT_T03.1
tttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22049 - DNA, 361 bp, Artificial
  MsCOMT deletion introduced by TALEN pair MsCOMT_T03.1
tttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22050 - DNA, 362 bp, Artificial
  MsCOMT deletion introduced by TALEN pair MsCOMT_T03.1
ttctcacaaaaacctcatcaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22051 - DNA, 360 bp, Artificial
  MsCOMT deletion introduced by TALEN pair MsCOMT_T03.1
ttctcacaaaaacctcatcaatcacaaccatgggttcaacaggtgaaactcaaataacaccaacccacatatcagatgaagacgcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 22052 - DNA, 355 bp, Artificial
  MsCOMT deletion introduced by TALEN pair MsCOMT_T03.1
ttcacaaaactcatcaatcacaaccatgggttcaacaggtgaaactcaaataacaccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22053 - DNA, 363 bp, Artificial
  MsCOMT deletion introduced by TALEN pair MsCOMT_T03.1
ttcacaaaacctcatcaatcacaaccatgggttcaacaggtgcaactcacataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22054 - DNA, 359 bp, Artificial
  MsCOMT deletion introduced by TALEN pair MsCOMT_T03.1
ttcacaaaacctcatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22055 - DNA, 331 bp, Artificial
  MsCOMT deletion introduced by TALEN pair MsCOMT_T03.1
ttcacaaaacctatcatcacaaccatgggttcaacaggtgaacctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatatgttgcgtctcttggcttgttacaatatcctcacttgttcagttcgtactcaacaagatggaaagattcagagactttatggtttggctactgttgctaa

SEQ ID NO: 22056 - DNA, 358 bp, Artificial
  MsCOMT deletion introduced by TALEN pair MsCOMT_T03.1
ttcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22057 - DNA, 359 bp, Artificial
  MsCOMT deletion introduced by TALEN pair MsCOMT_T03.1
ttcacaaaaacctcctcaatcacaaccattggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22058 - DNA, 432 bp, Artificial
  MsCOMT deletion introduced by TALEN pair MsCOMT_T03.1
ttcacaaaaacctcctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22059 - DNA, 349 bp, Artificial
  MsCOMT deletion introduced by TALEN pair MsCOMT_T03.1
ttcacaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22060 - DNA, 354 bp, Artificial
  MsCOMT deletion introduced by TALEN pair MsCOMT_T03.1
ttcacaaaaacctccaatcacaaccatgggttcaacaggtgacactcaaataacaccaacccacatatcagatgaagaagcaaacctcttcgccatgcaactagcaagtgcttcagttcttcccatgattttgaaatcagctcttgaacttgatttcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22061 - DNA, 361 bp, Artificial
  MsCOMT deletion introduced by TALEN pair MsCOMT_T03.1
ttcacaaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22062 - DNA, 356 bp, Artificial
  MsCOMT deletion introduced by TALEN pair MsCOMT_T03.1
ttcacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22063 - DNA, 298 bp, Artificial
  MsCOMT deletion introduced by TALEN pair MsCOMT_T03.1
ttcacaaaaacctcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 22064 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22065 - DNA, 357 bp, Artificial
  MsCOMT deletion introduced by TALEN pair MsCOMT_T03.1
ttcacaaaaacctcatcaatcacaaccatgggttcaacaggtgaaactcaaataacaccaacccacatatgagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcgacaagatggaaaggttcagagactttatggtttggctactgttgctaa

SEQ ID NO: 22066 - DNA, 357 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagtaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22067 - DNA, 356 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccattcaattagcaagtgcttcagttcttcccatgattttgaagtcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22068 - DNA, 350 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaacagttatgttggaccgaatgttgcgtctcttggcttgttacaatatcctcacttgttcagttcgtactcaacaagatggaaaagttcagagactttatggtttggctactgttgctaa

SEQ ID NO: 22069 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22070 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22071 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22072 - DNA, 247 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 22073 - DNA, 397 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaactaaccggtgctgtgccaggcccacggcttggccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22074 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22075 - DNA, 358 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 22076 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22077 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22078 - DNA, 356 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22079 - DNA, 354 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22080 - DNA, 344 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 22081 - DNA, 357 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22082 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22083 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22084 - DNA, 361 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22085 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 22086 - DNA, 361 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22087 - DNA, 356 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22088 - DNA, 356 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22089 - DNA, 358 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22090 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22091 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22092 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22093 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22094 - DNA, 206 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaaggttcagagactttatggtttggctactgttgctaa

SEQ ID NO: 22095 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22096 - DNA, 328 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22097 - DNA, 411 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22098 - DNA, 328 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatgaaaaggttcagagactttatggtttggctactgttgctaa

SEQ ID NO: 22099 - DNA, 364 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22100 - DNA, 353 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22101 - DNA, 356 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22102 - DNA, 357 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccaaatgttgcgtctcttggcttgttacaatatcctcacttgttcagttcgtactcaacaagatggaaaggttcagagcctttatggtttggctactgttgctaa

SEQ ID NO: 22103 - DNA, 358 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22104 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22105 - DNA, 358 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22106 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22107 - DNA, 358 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 22108 - DNA, 358 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22109 - DNA, 364 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22110 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22111 - DNA, 361 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22112 - DNA, 361 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 22113 - DNA, 354 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22114 - DNA, 346 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaacatgttggaccgaatgttgcgtctcttggcttgttacaatatcctcacttgttcagttcgtactcaacaagatggaaaggttcagagactttatggtttggctactgttgctaa

SEQ ID NO: 22115 - DNA, 356 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22116 - DNA, 360 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22117 - DNA, 350 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 22118 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccaaatgttgcatcgcttggcttgttaaaatatcctcacttgttcagttcgtacacaacaatatgaaaaggttcggaaactttatggtgtggctactgttgctaa

SEQ ID NO: 22119 - DNA, 359 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22120 - DNA, 356 bp, Artificial
  MsCOMT deletion introduced by TALEN pair MsCOMT_T03.1
ttcacaaaaacctcatcaatcacaaccatgggttcaacaggtgaaactcaaataacaccaacccacatatcagatgaagaagaaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22121 - DNA, 361 bp, Artificial
  MsCOMT deletion introduced by TALEN pair MsCOMT_T03.1
ttcacaaaaacctatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22122 - DNA, 428 bp, Artificial
  MsCOMT deletion introduced by TALEN pair MsCOMT_T03.1
ttcaaaaacctcatcaatcacaaccatgggttcaacaggtgaaactcaaataacaccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22123 - DNA, 359 bp, Artificial
  MsCOMT deletion introduced by TALEN pair MsCOMT_T03.1
ttacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22124 - DNA, 349 bp, Artificial
  MsCOMT deletion introduced by TALEN pair MsCOMT_T03.1
ttacaaaaacctcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaaggttcagagactttatggtttggctactgttgctaa

SEQ ID NO: 22125 - DNA, 353 bp, Artificial
  MsCOMT deletion introduced by TALEN pair MsCOMT_T03.1
ttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22126 - DNA, 344 bp, Artificial
  MsCOMT deletion introduced by TALEN pair MsCOMT_T03.1
ttaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 22127 - DNA, 358 bp, Artificial
  MsCOMT deletion introduced by TALEN pair MsCOMT_T03.1
ttaaaaacctcatcaatcacaaccatgggttcaacaggtgaaactcaaataaccccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22128 - DNA, 357 bp, Artificial
  MsCOMT deletion introduced by TALEN pair MsCOMT_T03.1
ttaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22129 - DNA, 362 bp, Artificial
  MsCOMT deletion introduced by TALEN pair MsCOMT_T03.1
tggcacaaaaacctcatcaatcgggggcaggggttcaacgggggaaactcaaataacaccaacccacatatcagatgaagaggcaaacctcttggccatgcaattatcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22130 - DNA, 349 bp, Artificial
  MsCOMT deletion introduced by TALEN pair MsCOMT_T03.1
tcttcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22131 - DNA, 364 bp, Artificial
  MsCOMT deletion introduced by TALEN pair MsCOMT_T03.1
tcttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22132 - DNA, 355 bp, Artificial
  MsCOMT deletion introduced by TALEN pair MsCOMT_T03.1
tcttcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22133 - DNA, 361 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22134 - DNA, 358 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22135 - DNA, 361 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22136 - DNA, 358 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22137 - DNA, 355 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaagattcagagactttatggtttggctactgttgctaa

SEQ ID NO: 22138 - DNA, 465 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagcccacggcttgaccccccagcaggtggtggccatcgccagccacgatggcggcaagcaggcgctgggagaggcggtttgcgtattgggcgctcttccgcttctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22139 - DNA, 361 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22140 - DNA, 360 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttctgttcgtactcaacaagatggaaaggttcagagactctatggtttggctactgttgctaa

SEQ ID NO: 22141 - DNA, 362 bp, Artificial
  MsCOMT deletion introduced by TALEN pair MsCOMT_T03.1
tcttacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22142 - DNA, 355 bp, Artificial
  MsCOMT deletion introduced by TALEN pair MsCOMT_T03.1
tctctcaaaaacctcatcaatcacaaccatgggttcaacaggtgaaactcaaataacaccaacccacatatcagatgaagaagcaaacctcttctccattcaattatcaatttcttcagttcttcccatgattttaaaatcagctcttgaactttatctcttataaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22143 - DNA, 358 bp, Artificial
  MsCOMT deletion introduced by TALEN pair MsCOMT_T03.1
tctctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctacggttgctaa

SEQ ID NO: 22144 - DNA, 361 bp, Artificial
  MsCOMT deletion introduced by TALEN pair MsCOMT_T03.1
tctctcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggatactgttgctaa

SEQ ID NO: 22145 - DNA, 361 bp, Artificial
  MsCOMT deletion introduced by TALEN pair MsCOMT_T03.1
tctcgcaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22146 - DNA, 471 bp, Artificial
  MsCOMT deletion introduced by TALEN pair MsCOMT_T03.1
tctcgcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcccacggcttgaccccggagcaggtggtggccatcgccagcaatattggtggcaagcaggcgctggagacggtgcaggcgctgttgccggtgctgtgccaggcccaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 22147 - DNA, 360 bp, Artificial
  MsCOMT deletion introduced by TALEN pair MsCOMT_T03.1
tctcgcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22148 - DNA, 362 bp, Artificial
  MsCOMT deletion introduced by TALEN pair MsCOMT_T03.1
tctcgcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22149 - DNA, 356 bp, Artificial
  MsCOMT deletion introduced by TALEN pair MsCOMT_T03.1
tctcgcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22150 - DNA, 360 bp, Artificial
  MsCOMT deletion introduced by TALEN pair MsCOMT_T03.1
tctcgcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatgaaaaagttcagagactttatggtttggctactgttgctaa

SEQ ID NO: 22151 - DNA, 362 bp, Artificial
  MsCOMT deletion introduced by TALEN pair MsCOMT_T03.1
tctcgcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 22152 - DNA, 348 bp, Artificial
  MsCOMT deletion introduced by TALEN pair MsCOMT_T03.1
tctccctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22153 - DNA, 367 bp, Artificial
  MsCOMT deletion introduced by TALEN pair MsCOMT_T03.1
tctcccccccccctcctccctcccccccattttttcaacattttaaactcaaataacaccaacccacatatcagatgaagaatcaaacctcttctccattcaactatcaatttcttcatttcttcccatgatttttaaatcatctcttgaacttgatctcttagaaatcattgctaaagctggaccttgtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 22154 - DNA, 361 bp, Artificial
  MsCOMT deletion introduced by TALEN pair MsCOMT_T03.1
tctcccccccccctcctccctcaccacccttttttccccattttaaactcaaataacaccaacccacatatcagatgaagaatcaaacctcttctccattcaattatcaatttcttcatttcttcccatgattttgaaatcagctctttaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22155 - DNA, 360 bp, Artificial
  MsCOMT deletion introduced by TALEN pair MsCOMT_T03.1
tctcccccccccctcctccctcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22156 - DNA, 358 bp, Artificial
  MsCOMT deletion introduced by TALEN pair MsCOMT_T03.1
tctcccccccccctcctccctcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 22157 - DNA, 357 bp, Artificial
  MsCOMT deletion introduced by TALEN pair MsCOMT_T03.1
tctcccccccccctcctccctcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaaggttcagagactttatggtttggctactgttgctaa

SEQ ID NO: 22158 - DNA, 361 bp, Artificial
  MsCOMT deletion introduced by TALEN pair MsCOMT_T03.1
tctcccccccccctcatccctcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22159 - DNA, 359 bp, Artificial
  MsCOMT deletion introduced by TALEN pair MsCOMT_T03.1
tctcccccccccctcatccctcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22160 - DNA, 362 bp, Artificial
  MsCOMT deletion introduced by TALEN pair MsCOMT_T03.1
tctcccccccccctcatccctcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22161 - DNA, 361 bp, Artificial
  MsCOMT deletion introduced by TALEN pair MsCOMT_T03.1
tctcccccccccctcatccctcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 22162 - DNA, 361 bp, Artificial
  MsCOMT deletion introduced by TALEN pair MsCOMT_T03.1
tctcccccccccctcatccctcacaaccatgggttcaacaggggaaactcaaataacaccaacccacatatcagatgaagaagcaaacctcttcgccatgaaactagcaagggcttcagttcttcccatgattttgaaatcagctcttgaacttgatctcttagaaatcattgctaaagctggacctggttctcaaatttcacctattgaaattgcttctcagctaacaacaacctgatgcaccagttatgttggaccgaatgttgcgtctcttggcttgttacaacatcctcccttgttcagttcgtactcaaccagatggaaaggttcagagactttatggtttggctactgttgctaa

SEQ ID NO: 22163 - DNA, 351 bp, Artificial
  MsCOMT deletion introduced by TALEN pair MsCOMT_T03.1
tctccccccaccctcatcaatcacaaccatgggttcaacaggtgaaactcaaataacaccaacccacatatcagatgaagaagcaaacctcttcgccctgcccttcgcccgtgcttccgttcttcccatgattttgacatcagctcttgaccttgctctcttcgccatcattgctaaagctggacctggttctcaaatttcacctattgaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 22164 - DNA, 360 bp, Artificial
  MsCOMT deletion introduced by TALEN pair MsCOMT_T03.1
tctccccccaccctcatcaatcacaaccatgggttcaacaggtgaaactcaaataacaccaacccacatatcagatgaagaagcaaacctcttcgccctgcccttcgcccgtgcttccgttcttcccatgattttcacctcagctcttgcccttgctctcttcgacatcattgctaccgctggccctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22165 - DNA, 361 bp, Artificial
  MsCOMT deletion introduced by TALEN pair MsCOMT_T03.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttgccctcagctcttgcacttgctctcttcgaaatccttgctaacgctggccctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22166 - DNA, 362 bp, Artificial
  MsCOMT deletion introduced by TALEN pair MsCOMT_T03.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttgcactcagctcttgcccttgctctcttcgccctcattgctaccgctggaccttgtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctaccgttcctaa

SEQ ID NO: 22167 - DNA, 361 bp, Artificial
  MsCOMT deletion introduced by TALEN pair MsCOMT_T03.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttgcaatcagctcttgaacttgctctcttcgccctccttgctacagctggccctggtgctcaaatttcacctattgaaattgcttctcagctaccaacaacctgatacaccagttatgttggaccgaatgttgcgtctcttggcttgttacaatatcctcacttgttcagttcgtactcaacaagatggaaagattcagagactttatggtttggctactgttgctaa

SEQ ID NO: 22168 - DNA, 355 bp, Artificial
  MsCOMT deletion introduced by TALEN pair MsCOMT_T03.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttgaactcagctcttgcccttgctctcttagacatcattgctaacgctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22169 - DNA, 365 bp, Artificial
  MsCOMT deletion introduced by TALEN pair MsCOMT_T03.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttgaactcagctcttgaccttgatctcttagacatcattgctaacgctggaccttgttctcaaatttcacctattgaaattgcttctcagcttccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22170 - DNA, 359 bp, Artificial
  MsCOMT deletion introduced by TALEN pair MsCOMT_T03.1
tctcccccacccctcctccatcacaaccatgggttcaacaggtgaaactcaaataacaccaacccacatatcagatgaagaagcaaacctcttcgccatgcaattagcccgtgcttcagttcttcccatgattttaaaatcagctcttgaacttgatctcttagaaatcattgctaaagctggacctggtgctcaaatttcacctattgaaattgcttctcagctcccaacaatgattcaccagttatgttggaccgaattttgcgtctcttggcttgttacaatatcctcacttgttcagttcgtactcaacaagatggaaaggttcagagcctttatggtttggctactgttgctaa

SEQ ID NO: 22171 - DNA, 360 bp, Artificial
  MsCOMT deletion introduced by TALEN pair MsCOMT_T03.1
tctcccccacccctcctccatcacaaccatgggttcaacaggtgaaactcaaataacaccaacccacatatcagatgaagaagcaaacctcttcgccatgcaactagcccgtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22172 - DNA, 360 bp, Artificial
  MsCOMT deletion introduced by TALEN pair MsCOMT_T03.1
tctcccccacccctcctccatcacaaccatgggttcaacaggtgaaactcaaataacaccaacccacatataagaggaagaagcaaacctcttcgccatgcaattagcccgtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 22173 - DNA, 360 bp, Artificial
  MsCOMT deletion introduced by TALEN pair MsCOMT_T03.1
tctcccccacccctcctccatcacaaccatgggttcaacaggtgaaactcaaataacaccaacccacatataagaggaagaagcaaacctcttcgccatgcaattagcccgtgcttcagttcttcccatgattttaaaatcagctcttgaacttgatctcttagaaatcattgctaaagctggacctggttctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 22174 - DNA, 470 bp, Artificial
  MsCOMT deletion introduced by TALEN pair MsCOMT_T03.1
tctcccccacccctcatcactcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggttctcaaatttcacctattgaaattgcttctcagctcccaacaactaagcagcaacgatgttacgcagcagggcagtcgccctaaaacaaagttaaacattatgagggaagcggtgatcgccgaagtatcgactcaactatcagaggtagttggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22175 - DNA, 356 bp, Artificial
  MsCOMT deletion introduced by TALEN pair MsCOMT_T03.1
tctcccccacccctcatcactcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22176 - DNA, 353 bp, Artificial
  MsCOMT deletion introduced by TALEN pair MsCOMT_T03.1
tctcccccacccctcatcactcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22177 - DNA, 360 bp, Artificial
  MsCOMT deletion introduced by TALEN pair MsCOMT_T03.1
tctcccccacccctcatcactcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22178 - DNA, 360 bp, Artificial
  MsCOMT deletion introduced by TALEN pair MsCOMT_T03.1
tctcccccacccctcatcactcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22179 - DNA, 361 bp, Artificial
  MsCOMT deletion introduced by TALEN pair MsCOMT_T03.1
tctcccccacccctcatcactcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22180 - DNA, 356 bp, Artificial
  MsCOMT deletion introduced by TALEN pair MsCOMT_T03.1
tctcccccacccctcatcactcacaaacatgggttcaacaggggaaactcaaataacaccgaccaacatatcagatgaagaagcaaacctcttcgccatgcaattagcaaggtcatcagttcttcccatgattttgaaatcagctcttgaacttgatctcttagaaatcattgctaaagctggacctgatgctcaaatttcacctattgaaattgcttctcagctaccactgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 22181 - DNA, 361 bp, Artificial
  MsCOMT deletion introduced by TALEN pair MsCOMT_T03.1
tctcccaaccccctcctccctcacaaccattttttcaacatgtgaaactcaaataacaccaacccacatatcagatgaagaagcaaacctcttcgccatgcaactatcaagttcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22182 - DNA, 442 bp, Artificial
  MsCOMT deletion introduced by TALEN pair MsCOMT_T03.1
tctcccaaaaacctcatcaatcacatccatgggttcaacagttgaaactcacataacaccaacccacatatcagatgaagaagcaaacctcttcgccatgcaattatcaagtgcttcagttcttcccatgattttcaaatcagctcttgaacttgatctcttcgaaatcattgctaaagctggacctggtgctcaaatttcacctattgaaattgcttctcagctcccaacaacaacgttcatatccgcgcccggcggatttggcgtactcaggagagcgtgcaccgacaaacaacagagaaagcgaaaggcccagtgatgcaccagttatgttggaccgaatgttgcgtctcttggcttgttacaatagcctcgcttgtgcagttcgtactcaagaagatggaaagattcagagacgttatggtttggctactgtggctaa

SEQ ID NO: 22183 - DNA, 359 bp, Artificial
  MsCOMT deletion introduced by TALEN pair MsCOMT_T03.1
tctcccaaaaacctcatcaatcacaaccctgggttcaacaggtgaaactcaaataacaccaacccacatatcagatgaagaagcaaacctcttcgccatgcaattcgcaagtgcttcagttcttcccatgattttaaaatcagctcttgaacttgatctcttagaaatcattgctaaagctggacctggtgctcaaatgtcacctattgaaagtgcttctcagctcccaacaatgatgcaccagttatgttggaccgaatgttgcgtctcttggcatgttacaataacctcacttgttcagttcgtactcaacaagatggaaaggttcagagacattatggtttggctactgttgctaa

SEQ ID NO: 22184 - DNA, 359 bp, Artificial
  MsCOMT deletion introduced by TALEN pair MsCOMT_T03.1
tctcccaaaaacctcatcaatcacaaccattgtttcaacaggtgaaactcaaataacaccaacccacatatcagatgaagaagcaaacctcttcgccatgcaactagcaatttcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22185 - DNA, 361 bp, Artificial
  MsCOMT deletion introduced by TALEN pair MsCOMT_T03.1
tctcccaaaaacctcatcaatcacaaccatgggttccacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22186 - DNA, 403 bp, Artificial
  MsCOMT deletion introduced by TALEN pair MsCOMT_T03.1
tctcccaaaaacctcatcaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattggaattgcttctcagctcccaacaacgcagtggaggcagtgcatgcagggcgcaatgcactgagcggggtgatgcaccagttatgttggaccgaatgttgcgtctcttggcttgttacaatatcctcacttgttcagttcgtactcaacaaaatggaaagattcagagactttatggtttggctactgttgctaa

SEQ ID NO: 22187 - DNA, 357 bp, Artificial
  MsCOMT deletion introduced by TALEN pair MsCOMT_T03.1
tctcccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccatctgatgcaccagttatgttgaaccgaatgttgcgtctcttggcttgttacatgagcctcagatgttcagttcgtacgcaacaagatggaaaaaatcagagactttatggtatggctactgttgataa

SEQ ID NO: 22188 - DNA, 356 bp, Artificial
  MsCOMT deletion introduced by TALEN pair MsCOMT_T03.1
tctcccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22189 - DNA, 277 bp, Artificial
  MsCOMT deletion introduced by TALEN pair MsCOMT_T03.1
tctcccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 22190 - DNA, 365 bp, Artificial
  MsCOMT deletion introduced by TALEN pair MsCOMT_T03.1
tctcccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 22191 - DNA, 361 bp, Artificial
  MsCOMT deletion introduced by TALEN pair MsCOMT_T03.1
tctcccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 22192 - DNA, 360 bp, Artificial
  MsCOMT deletion introduced by TALEN pair MsCOMT_T03.1
tctcccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcgcagctaccaacaactgatgcaccagttatgttggaccgaatgttgcgtctcttggcttgtgacaatatccgcacttgttcagttcgtactcaacaagatggaaaggttcagagactttatggtttggctactgttgctaa

SEQ ID NO: 22193 - DNA, 361 bp, Artificial
  MsCOMT deletion introduced by TALEN pair MsCOMT_T03.1
tctcccaaaaacctcatcaatcacaaccatgggttcaacaggtgaaactcaaataacaccaacccacatatcagatgaagaagcaaacctcttcgccatccaactagcaagtgcttcagttcttcccatgattttgaaatcagctcttgaacttgatctcttagaaatcattgctaaggctggacctggtgcttaaatttcacctattgaaattgcttctcagctaccaacaacctgatgcaccagttatgttggaccgaatgttgcgtctcttggcttgtgacaatatcctcacttgttcagttcgtactcaacaagatggaaaagttcagagactttatggtttggctactgtggctaa

SEQ ID NO: 22194 - DNA, 299 bp, Artificial
  MsCOMT deletion introduced by TALEN pair MsCOMT_T03.1
tctcccaaaaacctcatcaatcacaaacatgggttcaacaggtgaaaatcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 22195 - DNA, 344 bp, Artificial
  MsCOMT deletion introduced by TALEN pair MsCOMT_T03.1
tctccatcaatcacaaccatggtttcaacaggtgaaactcaactaacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22196 - DNA, 360 bp, Artificial
  MsCOMT deletion introduced by TALEN pair MsCOMT_T03.1
tctccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22197 - DNA, 350 bp, Artificial
  MsCOMT deletion introduced by TALEN pair MsCOMT_T03.1
tctccaaacctcatcaatcacaaccatgggttcaacgggtgacactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22198 - DNA, 353 bp, Artificial
  MsCOMT deletion introduced by TALEN pair MsCOMT_T03.1
tctccaaaactatcaatcacaaccatgggttcaacaggtgaacctcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22199 - DNA, 353 bp, Artificial
  MsCOMT deletion introduced by TALEN pair MsCOMT_T03.1
tctccaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22200 - DNA, 356 bp, Artificial
  MsCOMT deletion introduced by TALEN pair MsCOMT_T03.1
tctccaaaacctcatcaatcacaaccatgggttcaacaggtgaaactcaaataacaccaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22201 - DNA, 380 bp, Artificial
  MsCOMT deletion introduced by TALEN pair MsCOMT_T03.1
tctccaaaaactctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22202 - DNA, 358 bp, Artificial
  MsCOMT deletion introduced by TALEN pair MsCOMT_T03.1
tctccaaaaacctcctcaatcacaaccatgggttcaacaggtgaaactccaataacaccaacccacatatcagatgaagaagcaaacctcttcgccatgcaattagcaagtgcttcagttcttcccatgattttgaaatcagctcttgaacttgatctcttagaaatcattgctaaagctgtacctgatgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22203 - DNA, 347 bp, Artificial
  MsCOMT deletion introduced by TALEN pair MsCOMT_T03.1
tctccaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaaggttcagagactttatggtttggctactgttgctaa

SEQ ID NO: 22204 - DNA, 357 bp, Artificial
  MsCOMT deletion introduced by TALEN pair MsCOMT_T03.1
tctccaaaaacctcctcaatcacaaccatgggttcaacaggtgaaactcaaataacaccaacccacatatcagatgaagaagcaaacctcttcgccatgcaactagcaagtgcttcagtttttcccatgattttgaaatcagctcttgaacttggtttcttagaaatcattgctaaagctggacctggtgctaaaaattctcctattgaaattgcttctcagctacaaacaagatgcaccagttatgttggaccgaatgttgcgtctcttggctggttacaatatcctcacttgttcagttcgtactcaacaagattgaaaggttcagagcctttatggtttggctactgtggctaa

SEQ ID NO: 22205 - DNA, 357 bp, Artificial
  MsCOMT deletion introduced by TALEN pair MsCOMT_T03.1
tctccaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttgcaccgaatgttgcgtctcttggcttgttacaatatcctcacttgttcagttcgtactcaacaagatggaaaggttcagagactttatggtttggctactgttgctaa

SEQ ID NO: 22206 - DNA, 357 bp, Artificial
  MsCOMT deletion introduced by TALEN pair MsCOMT_T03.1
tctccaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaacctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22207 - DNA, 360 bp, Artificial
  MsCOMT deletion introduced by TALEN pair MsCOMT_T03.1
tctccaaaaacctcctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22208 - DNA, 359 bp, Artificial
  MsCOMT deletion introduced by TALEN pair MsCOMT_T03.1
tctccaaaaacctcatcatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22209 - DNA, 359 bp, Artificial
  MsCOMT deletion introduced by TALEN pair MsCOMT_T03.1
tctccaaaaacctcatcaatcacaaccattggttcaacaggtgaaactcaaataacaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22210 - DNA, 361 bp, Artificial
  MsCOMT deletion introduced by TALEN pair MsCOMT_T03.1
tctccaaaaacctcatcaatcacaaccatgggttcaacaggtgaaactcgaataacaccaacccacatatcagatgaagaagcaaacctcttcgccatgcgattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22211 - DNA, 360 bp, Artificial
  MsCOMT deletion introduced by TALEN pair MsCOMT_T03.1
tctccaaaaacctcatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 22212 - DNA, 357 bp, Artificial
  MsCOMT deletion introduced by TALEN pair MsCOMT_T03.1
tctccaaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22213 - DNA, 359 bp, Artificial
  MsCOMT deletion introduced by TALEN pair MsCOMT_T03.1
tctccaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaattttcacctattgaaattgcttcccagctaccaacaactgatgcaccagttatgttggaacgaatgtcgcgtcccttggcttgatacaatatcctcacttcttcagttcgtcctcaaccagatggaaaggctcagagactttatggttgggctactgctactaa

SEQ ID NO: 22214 - DNA, 349 bp, Artificial
  MsCOMT deletion introduced by TALEN pair MsCOMT_T03.1
tctccaaaaacctcatcaatcacaaccatgggttcaacaggtgaaactcaaataacaccaccccacatatcagatgaagaagcaaacctcttcgccatgcaactagcaagtgcttcagttcttcccatgattttgacatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttgactactgttgctaa

SEQ ID NO: 22215 - DNA, 360 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22216 - DNA, 360 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22217 - DNA, 354 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22218 - DNA, 356 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggcactgttgctat

SEQ ID NO: 22219 - DNA, 248 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggcttgttacaatatcctcacttgttcagttcgtactcaacaagatggaaaggttcagagactttatggtttggctactgttgctaa

SEQ ID NO: 22220 - DNA, 354 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22221 - DNA, 359 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22222 - DNA, 247 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 22223 - DNA, 288 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaaggttcagagactttatggtttggctactgttgctaa

SEQ ID NO: 22224 - DNA, 351 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22225 - DNA, 358 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22226 - DNA, 437 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22227 - DNA, 360 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22228 - DNA, 357 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22229 - DNA, 358 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22230 - DNA, 360 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22231 - DNA, 360 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22232 - DNA, 351 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 22233 - DNA, 352 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22234 - DNA, 355 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22235 - DNA, 359 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22236 - DNA, 359 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22237 - DNA, 360 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22238 - DNA, 301 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22239 - DNA, 356 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22240 - DNA, 432 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22241 - DNA, 361 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22242 - DNA, 357 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22243 - DNA, 358 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22244 - DNA, 359 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22245 - DNA, 359 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22246 - DNA, 361 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcatttgttcagttcgtactcaacaagatggaaaagttcagagactttatggtttggctactgttgctaa

SEQ ID NO: 22247 - DNA, 346 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaaggttcagagactttatggtttggctactgttgctaa

SEQ ID NO: 22248 - DNA, 339 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22249 - DNA, 359 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22250 - DNA, 361 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22251 - DNA, 359 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 22252 - DNA, 360 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22253 - DNA, 351 bp, Artificial
  MsCOMT deletion introduced by TALEN pair MsCOMT_T03.1
tctccaaaaacctcatcaatcacaaccatgggttcaacaggtgaaactcaaataacaccaacccacatatcagatgaagaagcaaacctcttcgccatgcaactagcaagtgcttcagttcttcccatgatttggaaatcaactcttgaacttgatctcttagaaatcattgctaaagctggacctgttgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggcttctgttgctaa

SEQ ID NO: 22254 - DNA, 345 bp, Artificial
  MsCOMT deletion introduced by TALEN pair MsCOMT_T03.1
tctcatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 22255 - DNA, 358 bp, Artificial
  MsCOMT deletion introduced by TALEN pair MsCOMT_T03.1
tctcataaaaacctcatcaatcacaaccatgggttcaacaggtgaaactcaaataacaccaacccacatatcagatgaagaagcgaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22256 - DNA, 361 bp, Artificial
  MsCOMT deletion introduced by TALEN pair MsCOMT_T03.1
tctcataaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaatgctggccctggtgctcaaatttcacctattgaaattgcttctcagctcccaacaacttgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22257 - DNA, 360 bp, Artificial
  MsCOMT deletion introduced by TALEN pair MsCOMT_T03.1
tctcataaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22258 - DNA, 361 bp, Artificial
  MsCOMT deletion introduced by TALEN pair MsCOMT_T03.1
tctcataaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22259 - DNA, 299 bp, Artificial
  MsCOMT deletion introduced by TALEN pair MsCOMT_T03.1
tctcagaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtatcttggcttgttacaatatcctcacttgttcagttcgtactcaacaagatggaaaggttcagagactttatggtttggctactgttgctaa

SEQ ID NO: 22260 - DNA, 356 bp, Artificial
  MsCOMT deletion introduced by TALEN pair MsCOMT_T03.1
tctcactaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22261 - DNA, 358 bp, Artificial
  MsCOMT deletion introduced by TALEN pair MsCOMT_T03.1
tctcactaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcacccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22262 - DNA, 365 bp, Artificial
  MsCOMT deletion introduced by TALEN pair MsCOMT_T03.1
tctcactaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22263 - DNA, 361 bp, Artificial
  MsCOMT deletion introduced by TALEN pair MsCOMT_T03.1
tctcacgaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 22264 - DNA, 359 bp, Artificial
  MsCOMT deletion introduced by TALEN pair MsCOMT_T03.1
tctcacgaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctga

SEQ ID NO: 22265 - DNA, 361 bp, Artificial
  MsCOMT deletion introduced by TALEN pair MsCOMT_T03.1
tctcacgaaaacctcatcaatcacaaccatgggttcaacaggtgaaactcaaataacaccaacccacatatcagatgaagaagcaaaactcttcgccatgcaactagcaagtccttcagttcttcccatgattttgaaatcagctcttgaacttgatctattagaaatcattgctaaagctagacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22266 - DNA, 356 bp, Artificial
  MsCOMT deletion introduced by TALEN pair MsCOMT_T03.1
tctcacgaaaacctcatcaatcacaaccatgggttcaacaggggaaacacaaataacaccaacccacatatcagatgaagaagcaaacctcttcgccatgcaattagcaagggcttcagttcttcccatgattttaaaatcagctcttgaacttgatctcttagaaatcattgctaaagctgtacctggtgctcaaatttcacctattgaaattgcttctcagctaccaatgatgcaccagttatgttggaccgaatgttgcgtctcttggcttgttacaatatcctcacttgttcacttcgtactcaaccagatggaaaggttcagagactttatggtttggctactgttccaaa

SEQ ID NO: 22267 - DNA, 355 bp, Artificial
  MsCOMT deletion introduced by TALEN pair MsCOMT_T03.1
tctcacctcatcaatcacaaccatgggttcaacaggtgaaactcaaataacaccaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 22268 - DNA, 289 bp, Artificial
  MsCOMT deletion introduced by TALEN pair MsCOMT_T03.1
tctcacccaaacctcatcaatcacaaccattggttcaacaggtgaaactcaaataacaccaacccacatatcagatgaagaagcaaacctcttcgccatgcaattagcaagtgcttcatttcttcccatgattttgaaatcatctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 22269 - DNA, 360 bp, Artificial
  MsCOMT deletion introduced by TALEN pair MsCOMT_T03.1
tctcaccaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22270 - DNA, 358 bp, Artificial
  MsCOMT deletion introduced by TALEN pair MsCOMT_T03.1
tctcacagaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22271 - DNA, 360 bp, Artificial
  MsCOMT deletion introduced by TALEN pair MsCOMT_T03.1
tctcacagaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22272 - DNA, 360 bp, Artificial
  MsCOMT deletion introduced by TALEN pair MsCOMT_T03.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22273 - DNA, 394 bp, Artificial
  MsCOMT deletion introduced by TALEN pair MsCOMT_T03.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctaccaacatctattgcgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22274 - DNA, 361 bp, Artificial
  MsCOMT deletion introduced by TALEN pair MsCOMT_T03.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22275 - DNA, 361 bp, Artificial
  MsCOMT deletion introduced by TALEN pair MsCOMT_T03.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22276 - DNA, 360 bp, Artificial
  MsCOMT deletion introduced by TALEN pair MsCOMT_T03.1
tctcacacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22277 - DNA, 361 bp, Artificial
  MsCOMT deletion introduced by TALEN pair MsCOMT_T03.1
tctcacacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacatgttcagttcgtactcaacaagatggaaaggttcagagactttatggtttggctactgttgctaa

SEQ ID NO: 22278 - DNA, 361 bp, Artificial
  MsCOMT deletion introduced by TALEN pair MsCOMT_T03.1
tctcacacaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcgtggcttgttacaatatcctcacttgttctgttcgtactcaacaagatggaaaggttcagagactttatggtttggctactgttgctaa

SEQ ID NO: 22279 - DNA, 356 bp, Artificial
  MsCOMT deletion introduced by TALEN pair MsCOMT_T03.1
tctcacaatcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22280 - DNA, 365 bp, Artificial
  MsCOMT deletion introduced by TALEN pair MsCOMT_T03.1
tctcacaataacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22281 - DNA, 294 bp, Artificial
  MsCOMT deletion introduced by TALEN pair MsCOMT_T03.1
tctcacaataacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22282 - DNA, 359 bp, Artificial
  MsCOMT deletion introduced by TALEN pair MsCOMT_T03.1
tctcacaagaaccttatcaatcacaaccatgggttcaacatgcgaaactcaaataacaccaacccacatatcagatgaagaatcaaacctcttcgccaaccgattaacaagtgcttcagttcttcccatgagtttaaaatcagctcttgaacttgatctcttagaaatcattgctaaagctggccctggtactcaaatttcacatattgaaattgcttctaagctaccatcgactaaacaccagttatgttggaccgaatgttgagtctcctggcttgttacactatcctctcttgttctgttcgtacccaacaagatggaatggttcagagacattactgtttggcgactgttgctaa

SEQ ID NO: 22283 - DNA, 360 bp, Artificial
  MsCOMT deletion introduced by TALEN pair MsCOMT_T03.1
tctcacaagaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22284 - DNA, 355 bp, Artificial
  MsCOMT deletion introduced by TALEN pair MsCOMT_T03.1
tctcacaagaacctcatcaatcacaaccatgggttcaacaggtgaaactcaaataacaccaacccacatatcagatgaagaagcaaacctcttcgccatgcaactagcaagtgcttcccttcttcccatgattttgaaatcagctcttgaacttgatctcttagaaatcattgctaaagcttgacctggtgctcaaatttcacctattgaaagtgcttctcagctaccaacatgcaccagttatgttggaccgaatgttgcgtctgttggcttgttacaatatcctcacttgttcagttcgtactcaacaagatggaaaggttcagagactttatggtttggatactgttgctaa

SEQ ID NO: 22285 - DNA, 361 bp, Artificial
  MsCOMT deletion introduced by TALEN pair MsCOMT_T03.1
tctcacaagaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22286 - DNA, 352 bp, Artificial
  MsCOMT deletion introduced by TALEN pair MsCOMT_T03.1
tctcacaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22287 - DNA, 264 bp, Artificial
  MsCOMT deletion introduced by TALEN pair MsCOMT_T03.1
tctcacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 22288 - DNA, 356 bp, Artificial
  MsCOMT deletion introduced by TALEN pair MsCOMT_T03.1
tctcacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22289 - DNA, 358 bp, Artificial
  MsCOMT deletion introduced by TALEN pair MsCOMT_T03.1
tctcacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22290 - DNA, 352 bp, Artificial
  MsCOMT deletion introduced by TALEN pair MsCOMT_T03.1
tctcacaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22291 - DNA, 365 bp, Artificial
  MsCOMT deletion introduced by TALEN pair MsCOMT_T03.1
tctcacaacaacctcatcaatcacaaccatgttttcaacaggtgaaactcaaataacaccaacccacatatcagatgaagaagcaaacctcttcgccattcaactagcaattgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22292 - DNA, 260 bp, Artificial
  MsCOMT deletion introduced by TALEN pair MsCOMT_T03.1
tctcacaacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttgtaccgaatgttgcgtctcttggcttgttacaatatcctcacttgttcagttcgtactcaacaagatggaaaggttcagagactttatggtttggctactgttgctaa

SEQ ID NO: 22293 - DNA, 348 bp, Artificial
  MsCOMT deletion introduced by TALEN pair MsCOMT_T03.1
tctcacaaatcatcaatcacaaccatgggttcaacaggtgaacctcaaataaccccaacccacatatcagatgacgaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22294 - DNA, 360 bp, Artificial
  MsCOMT deletion introduced by TALEN pair MsCOMT_T03.1
tctcacaaatacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22295 - DNA, 356 bp, Artificial
  MsCOMT deletion introduced by TALEN pair MsCOMT_T03.1
tctcacaaagacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22296 - DNA, 360 bp, Artificial
  MsCOMT deletion introduced by TALEN pair MsCOMT_T03.1
tctcacaaagacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22297 - DNA, 342 bp, Artificial
  MsCOMT deletion introduced by TALEN pair MsCOMT_T03.1
tctcacaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttgctaa

SEQ ID NO: 22298 - DNA, 361 bp, Artificial
  MsCOMT deletion introduced by TALEN pair MsCOMT_T03.1
tctcacaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22299 - DNA, 359 bp, Artificial
  MsCOMT deletion introduced by TALEN pair MsCOMT_T03.1
tctcacaaacctcatcaatcacaaccatgtgttcaacaggtgcaactcaaataccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22300 - DNA, 356 bp, Artificial
  MsCOMT deletion introduced by TALEN pair MsCOMT_T03.1
tctcacaaacctcatcaatcacaaccatgggttcaacaggtgcaactcaaataacaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22301 - DNA, 336 bp, Artificial
  MsCOMT deletion introduced by TALEN pair MsCOMT_T03.1
tctcacaaacctcatcaatcacaaccatgggttcaacaggtgcaactcaaataacaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22302 - DNA, 355 bp, Artificial
  MsCOMT deletion introduced by TALEN pair MsCOMT_T03.1
tctcacaaacctcatcaatcacaaccatgggttcaacaggtgcaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22303 - DNA, 358 bp, Artificial
  MsCOMT deletion introduced by TALEN pair MsCOMT_T03.1
tctcacaaacctcatcaatcacaaccatgggttcaacaggtgcaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22304 - DNA, 356 bp, Artificial
  MsCOMT deletion introduced by TALEN pair MsCOMT_T03.1
tctcacaaacctcatcaatcacaaccatgggttcaacaggtgcaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 22305 - DNA, 350 bp, Artificial
  MsCOMT deletion introduced by TALEN pair MsCOMT_T03.1
tctcacaaacctcatcaatcacaaccatgggttcaacaggtgaaactcaaataccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22306 - DNA, 354 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttaagttcgtactcaacaagatggaaagattcagagactttatggtttggctactgttgcta

SEQ ID NO: 22307 - DNA, 347 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcaattgttcagttcgtactcaacaagatggaaagattcagagactgtatgggttggctactggtgctaa

SEQ ID NO: 22308 - DNA, 358 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22309 - DNA, 359 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22310 - DNA, 358 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22311 - DNA, 346 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 22312 - DNA, 443 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22313 - DNA, 355 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 22314 - DNA, 358 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22315 - DNA, 359 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22316 - DNA, 357 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22317 - DNA, 247 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaagattcagagactttatggtttggctactgttgctaa

SEQ ID NO: 22318 - DNA, 357 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22319 - DNA, 360 bp, Artificial
  MsCOMT deletion introduced by TALEN pair MsCOMT_T03.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22320 - DNA, 365 bp, Artificial
  MsCOMT deletion introduced by TALEN pair MsCOMT_T03.1
tctcacaaacacctcatcactcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatccgcacttgttcagttcgtactcaacaagatggaaaggttcagagactttagggtttggctactgttgctaa

SEQ ID NO: 22321 - DNA, 360 bp, Artificial
  MsCOMT deletion introduced by TALEN pair MsCOMT_T03.1
tctcacaaacacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22322 - DNA, 345 bp, Artificial
  MsCOMT deletion introduced by TALEN pair MsCOMT_T03.1
tctcacaaacacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22323 - DNA, 355 bp, Artificial
  MsCOMT deletion introduced by TALEN pair MsCOMT_T03.1
tctcacaaacacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22324 - DNA, 388 bp, Artificial
  MsCOMT deletion introduced by TALEN pair MsCOMT_T03.1
tctcacaaacacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccccagcgcctgcttgccaccgccacatgcacaagttatgttggaccgaatgttgcgtctcttggcttgttacaatatcctcacttgttctgttcgtactcaacaagatggaaaggttcagagactttatggtttggctactgttgctaa

SEQ ID NO: 22325 - DNA, 358 bp, Artificial
  MsCOMT deletion introduced by TALEN pair MsCOMT_T03.1
tctcacaaaatcctcatcaatcacaaccatgggttcaacaggtgaaattcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22326 - DNA, 351 bp, Artificial
  MsCOMT deletion introduced by TALEN pair MsCOMT_T03.1
tctcacaaaatcctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22327 - DNA, 358 bp, Artificial
  MsCOMT deletion introduced by TALEN pair MsCOMT_T03.1
tctcacaaaatcctcatcaatcacaaccataggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgattcaccagttatgttggaccgaatgttgcgtctcttggctagttacaatatcctcacttgttcagttcgtactcaacaatatggaaaggttcagagactttatggtttggctacttttgctaa

SEQ ID NO: 22328 - DNA, 358 bp, Artificial
  MsCOMT deletion introduced by TALEN pair MsCOMT_T03.1
tctcacaaaatcctcatcaatcacaaccataggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22329 - DNA, 358 bp, Artificial
  MsCOMT deletion introduced by TALEN pair MsCOMT_T03.1
tctcacaaaatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22330 - DNA, 359 bp, Artificial
  MsCOMT deletion introduced by TALEN pair MsCOMT_T03.1
tctcacaaaagcctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22331 - DNA, 350 bp, Artificial
  MsCOMT deletion introduced by TALEN pair MsCOMT_T03.1
tctcacaaaagcctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22332 - DNA, 359 bp, Artificial
  MsCOMT deletion introduced by TALEN pair MsCOMT_T03.1
tctcacaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22333 - DNA, 358 bp, Artificial
  MsCOMT deletion introduced by TALEN pair MsCOMT_T03.1
tctcacaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgtaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22334 - DNA, 358 bp, Artificial
  MsCOMT deletion introduced by TALEN pair MsCOMT_T03.1
tctcacaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22335 - DNA, 360 bp, Artificial
  MsCOMT deletion introduced by TALEN pair MsCOMT_T03.1
tctcacaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 22336 - DNA, 357 bp, Artificial
  MsCOMT deletion introduced by TALEN pair MsCOMT_T03.1
tctcacaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactttgctaa

SEQ ID NO: 22337 - DNA, 360 bp, Artificial
  MsCOMT deletion introduced by TALEN pair MsCOMT_T03.1
tctcacaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgacctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22338 - DNA, 356 bp, Artificial
  MsCOMT deletion introduced by TALEN pair MsCOMT_T03.1
tctcacaaaacctctcaatcacaaccatgggttcaacaggtgaaactcacataacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22339 - DNA, 358 bp, Artificial
  MsCOMT deletion introduced by TALEN pair MsCOMT_T03.1
tctcacaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22340 - DNA, 360 bp, Artificial
  MsCOMT deletion introduced by TALEN pair MsCOMT_T03.1
tctcacaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22341 - DNA, 361 bp, Artificial
  MsCOMT deletion introduced by TALEN pair MsCOMT_T03.1
tctcacaaaacctcctcaatcacaaccattggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22342 - DNA, 362 bp, Artificial
  MsCOMT deletion introduced by TALEN pair MsCOMT_T03.1
tctcacaaaacctcctcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcacctattgaaattgcttctcagctaccaacaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22343 - DNA, 359 bp, Artificial
  MsCOMT deletion introduced by TALEN pair MsCOMT_T03.1
tctcacaaaacctcctcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22344 - DNA, 359 bp, Artificial
  MsCOMT deletion introduced by TALEN pair MsCOMT_T03.1
tctcacaaaacctcctcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22345 - DNA, 357 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatggagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22346 - DNA, 357 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22347 - DNA, 360 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22348 - DNA, 350 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22349 - DNA, 276 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 22350 - DNA, 359 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22351 - DNA, 358 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 22352 - DNA, 351 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 22353 - DNA, 350 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 22354 - DNA, 357 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgctgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22355 - DNA, 360 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 22356 - DNA, 355 bp, Artificial
  MsCOMT deletion introduced by TALEN pair MsCOMT_T03.1
tctcacaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22357 - DNA, 357 bp, Artificial
  MsCOMT deletion introduced by TALEN pair MsCOMT_T03.1
tctcacaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22358 - DNA, 359 bp, Artificial
  MsCOMT deletion introduced by TALEN pair MsCOMT_T03.1
tctcacaaaacctcatcaatcacaaccatgggttcaacaggtgaaactccaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22359 - DNA, 354 bp, Artificial
  MsCOMT deletion introduced by TALEN pair MsCOMT_T03.1
tctcacaaaacctcatcaatcacaaccatgggttcaacaggtgaaactccaataacaccaacccacatatcagatgaagaagcgaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 22360 - DNA, 358 bp, Artificial
  MsCOMT deletion introduced by TALEN pair MsCOMT_T03.1
tctcacaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22361 - DNA, 396 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaaagttcagagactttatggtttggctactgttgccaa

SEQ ID NO: 22362 - DNA, 352 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 22363 - DNA, 359 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22364 - DNA, 360 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttccaatatcctcacttgttcagttcgtactcaacaagatggaaaggttcagagactttatggtttggctactgttgctaa

SEQ ID NO: 22365 - DNA, 360 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcatctcttgaacttgatctcttagaaatcattgctaaagctggacctggtgctcaaatttcacctattgaaattgcttctcagctaccaacaacctgatgaaccagttatgttggaccgaatgttgcgtcacttggcttgttacaatatcctaacttgttcagttcgtactcaacaagatggaaaggttcagagactttatggtttggctactgttgctaa

SEQ ID NO: 22366 - DNA, 301 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 22367 - DNA, 357 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22368 - DNA, 356 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22369 - DNA, 359 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22370 - DNA, 357 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22371 - DNA, 359 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22372 - DNA, 360 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22373 - DNA, 360 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22374 - DNA, 314 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22375 - DNA, 361 bp, Artificial
  MsCOMT deletion introduced by TALEN pair MsCOMT_T03.1
tctcacaaaacctcatcaatcacaaccatgggttcaacaggtgaaactcaaatcacaccaacccacatatcagatgaagaagcaaacctcttcgccatacaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactggtgctaa

SEQ ID NO: 22376 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacctatcagatgaagaagcaaacctcttcgccatgcaactctcaagtccttcagttcttcccatgattttgaaatcagctcttgaacttgatctcttagaaatcattgctaaagctggacctggtgctcaaatttcacctattgaaattgcttctcagctgccaacaactgatgcaccagttatgttggaccgaatgttgcggctcttggcttgttacaatatcctcacttgttcagttcgtactcaacaagatggaaaagttcagagactttatggtttggctactgttgctaa

SEQ ID NO: 22377 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22378 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaggcaaacctcttcgccatgcaattagcaagtgcttcagttcttcccatgattttaaaatcagctcttgaacttgatctcttagaaatcattgctaaagctggacctggtgctcaaatttcacctattgaatttgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22379 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccgtgcaattagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22380 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagttcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22381 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22382 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22383 - DNA, 353 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22384 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22385 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 22386 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcatctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22387 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctactgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22388 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22389 - DNA, 351 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22390 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 22391 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttagaccgaatgttgcgtctcttggcttgttacaatatcctcacttgttcagttcgtactcaacaagatggaaagattcagagactttatggtttggctactgttgctaa

SEQ ID NO: 22392 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22393 - DNA, 355 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggtactgttgctaa

SEQ ID NO: 22394 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22395 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22396 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttctcatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22397 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccattattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22398 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgatttttaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22399 - DNA, 234 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgacttgttacaatatcctcacttgttcagttcgtactcaacaagatggaaagattcagagactttatggtttggctactgttgctaa

SEQ ID NO: 22400 - DNA, 266 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 22401 - DNA, 301 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 22402 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22403 - DNA, 316 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22404 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22405 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 22406 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaacttgcaccagttatgttggaccgaacgttgcgtctcttggcttgttacaatatcctcacttgttcagttcgtactcaacaagatggaaaggttcagagactttatggtttggctactgttgctaa

SEQ ID NO: 22407 - DNA, 339 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaggttcagagactgtatggtttggctactgttgctaa

SEQ ID NO: 22408 - DNA, 349 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 22409 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22410 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22411 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22412 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22413 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22414 - DNA, 295 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagccggacctggtgctcaaatttcacctattgaaattgttacaatatcctcacttgttcagttcgtactcaacaagatggaaaagttcagagactttatggtttggctactgttgctaa

SEQ ID NO: 22415 - DNA, 259 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 22416 - DNA, 432 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagcccttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22417 - DNA, 247 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 22418 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22419 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22420 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctaccaacaacctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 22421 - DNA, 234 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggcttgttacaatatcctcacttgttcagttcgtactcaacaagatggaaaggttcagagactttatggtttggctactgttgctaa

SEQ ID NO: 22422 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctaccaacaacctgatgcaccagttatgtttgaccgaatgtttcgtctcttggcttgttacaatatcctcacttgttcagttcgtactcaacaagatggaaagattcagagactttatggtttcgctactgttgctaa

SEQ ID NO: 22423 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagttatgttggaccgaatgttgcgtctcttggcttgttacaatatcctcaattgttcagttcgtactcaacaagatggaaagattcagagactttatggtttggctactgttgctaa

SEQ ID NO: 22424 - DNA, 364 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22425 - DNA, 366 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22426 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22427 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22428 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22429 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22430 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22431 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22432 - DNA, 353 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22433 - DNA, 339 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaagattcagagactttatggtttggctactgttgctaa

SEQ ID NO: 22434 - DNA, 349 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22435 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22436 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 22437 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22438 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22439 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22440 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgctgcaccagttatgttggaccgaatgttgcgtctcttggcttgttacaatatcctcacttgttcagttcgtactcaacaagatggaaaggttcagagactttatggtttggctactgttgctaa

SEQ ID NO: 22441 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22442 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22443 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 22444 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccaaatgttgcgtctcttggcttgttacaatatcctcacttgttcagttcgtactcaacaagatggaaagattcagagactttatggtttggctactgttgctaa

SEQ ID NO: 22445 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22446 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22447 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22448 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22449 - DNA, 342 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 22450 - DNA, 347 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatattggaccgaatgttgcgtctcttggcttgttacaatatcctcacttgttcagttcgtactcaacaagatggaaagattcagagactttatggtttggctactgttgctaa

SEQ ID NO: 22451 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 22452 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22453 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgtttgaccgaatgttgcgtctcttggcttgatacaatatcctcacttgttcagttcgtacgcaacaagatggaaaggttcagagcctttatggtttggctactggtgctaa

SEQ ID NO: 22454 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22455 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22456 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22457 - DNA, 335 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaaggttcagagactttatggtttggctactgttgctaa

SEQ ID NO: 22458 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22459 - DNA, 363 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22460 - DNA, 364 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22461 - DNA, 402 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22462 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22463 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 22464 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22465 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22466 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22467 - DNA, 351 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 22468 - DNA, 353 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22469 - DNA, 351 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22470 - DNA, 353 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22471 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22472 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22473 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22474 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22475 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22476 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22477 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22478 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22479 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggtgcagagactttatggtttggctatgtgctaa

SEQ ID NO: 22480 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 22481 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22482 - DNA, 427 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatcaacttgaccccggagcaggtggtggccatcgccagccacgatggcggcaagcaggcgctggacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22483 - DNA, 362 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22484 - DNA, 364 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22485 - DNA, 389 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacggatggcctttttgcgtttctacaatctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22486 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22487 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22488 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22489 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22490 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22491 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22492 - DNA, 349 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22493 - DNA, 343 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22494 - DNA, 320 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggctactgttgctaa

SEQ ID NO: 22495 - DNA, 288 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 22496 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctcaaatttcacctgttcaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22497 - DNA, 206 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaagattcagagactttatggtttggctactgttgctaa

SEQ ID NO: 22498 - DNA, 268 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctgcaccagttatgttggaccgaatgttgcgtctcttggcttgttacaatatcctcacttgttcagttcgtactcaacaagatggaaagattcagagactttatggtttggctactgttgctaa

SEQ ID NO: 22499 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22500 - DNA, 364 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagtttttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22501 - DNA, 234 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgacttgttacaatatcctcacttgttcagttcgtactcaacaagatggaaagattcagagactttatggtttggctactgttgctaa

SEQ ID NO: 22502 - DNA, 266 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttcagttcgtactcaacaagatggaaaagttcagagactttatggtttggctactgttgctaa

SEQ ID NO: 22503 - DNA, 293 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22504 - DNA, 309 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcttggcttgttacaatatcctcacttgttctgttcgtactcaacaagatggaaaggttcagagactttatggtttggctactgttgctaa

SEQ ID NO: 22505 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 22506 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22507 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22508 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 22509 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgcta

SEQ ID NO: 22510 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22511 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22512 - DNA, 348 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatttatgttggaccgaatgttgcgtctcttggattgttacaatatcctcacttgttcagttcgtactcaacaagatggaaagattcagagactttatggtttggctactgttgctaa

SEQ ID NO: 22513 - DNA, 334 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaagattcagagactttatggtttggctactgttgctaa

SEQ ID NO: 22514 - DNA, 276 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 22515 - DNA, 345 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaggttcagagactttatggtttggctactgttgctaa

SEQ ID NO: 22516 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagacggaaagattcagagactttatggtttggctactgttgctaa

SEQ ID NO: 22517 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22518 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22519 - DNA, 444 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22520 - DNA, 364 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22521 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22522 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22523 - DNA, 353 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22524 - DNA, 351 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22525 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22526 - DNA, 412 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22527 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22528 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22529 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22530 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22531 - DNA, 354 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22532 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22533 - DNA, 350 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttcagttcgtactcaacaagatggaaaagttcagagactttatggtttggctactgttgctaa

SEQ ID NO: 22534 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttctgagactttatggtttggctactgttgctaa

SEQ ID NO: 22535 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 22536 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22537 - DNA, 350 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 22538 - DNA, 355 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22539 - DNA, 355 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgtggcgtcgcttggcttgttacaatatcctcacttgttcagttcgtactcaacaagatggaaaggttcagagactttagggtttggctactgttgctaa

SEQ ID NO: 22540 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22541 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22542 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 22543 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22544 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22545 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 22546 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22547 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22548 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22549 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttgggccgaatgtggcgtctcttggcttgttacaagatccgcacgtgttcagttcgtactgaagaagatggaaaggttcagaggcttgatggttgggcgactggggctaa

SEQ ID NO: 22550 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22551 - DNA, 392 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22552 - DNA, 362 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22553 - DNA, 364 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22554 - DNA, 419 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccgtgggcctggcacagcaccggcaccagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22555 - DNA, 414 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgccattatctccgacgcactgaaccacgcgtctattattgatggtgtgcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22556 - DNA, 397 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22557 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22558 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22559 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 22560 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22561 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaacatcctcacttgttcagttcgtactcaacaagatggaaaggttcagagactttatggtttggctactgttgctaa

SEQ ID NO: 22562 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22563 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22564 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 22565 - DNA, 361 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaacgttgcgtctcttggcttgttacaatatcctcacttgttcagttcgtactcaacaagatggaaaagttcagagactttatggtttggctactgttgctaa

SEQ ID NO: 22566 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22567 - DNA, 353 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 22568 - DNA, 348 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaagttcagagactttatggtttggctactgttgctaa

SEQ ID NO: 22569 - DNA, 269 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 22570 - DNA, 337 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22571 - DNA, 339 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22572 - DNA, 349 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccaattgaaattgcttctcagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22573 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtcctcaaatttcacctgttcaaattgcttctcagcttccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22574 - DNA, 298 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagacgttatggtttggctactgttgctaa

SEQ ID NO: 22575 - DNA, 206 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctacaagatggaaaggttcagagactttatggtttggctactgttgctaa

SEQ ID NO: 22576 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22577 - DNA, 259 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 22578 - DNA, 294 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 22579 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22580 - DNA, 350 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22581 - DNA, 357 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 22582 - DNA, 276 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 22583 - DNA, 355 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctagttgctaa

SEQ ID NO: 22584 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22585 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22586 - DNA, 363 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22587 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22588 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22589 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22590 - DNA, 358 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22591 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22592 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22593 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22594 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgatttagaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22595 - DNA, 356 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattgtgaaatcagctcttgaacttgatctcttagaaatcattgctaaatctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22596 - DNA, 345 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaagattcagagactttatggtttggctactgttgctaa

SEQ ID NO: 22597 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagcaaacctcttccccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22598 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagaaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22599 - DNA, 352 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22600 - DNA, 360 bp, Artificial
  MsCOMT deletion introduced by TALEN pair MsCOMT_T03.1
tctcacaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22601 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaacccacataccagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22602 - DNA, 359 bp, Artificial
  MsCOMT deletion introduced by TALEN pair MsCOMT_T03.1
tctcacaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22603 - DNA, 360 bp, Artificial
  MsCOMT deletion introduced by TALEN pair MsCOMT_T03.1
tctcacaaaacctcatcaatcacaaccatgggttcaacaggtgaaactaaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22604 - DNA, 352 bp, Artificial
  MsCOMT deletion introduced by TALEN pair MsCOMT_T03.1
tctcacaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22605 - DNA, 259 bp, Artificial
  MsCOMT deletion introduced by TALEN pair MsCOMT_T03.1
tctcacaaaacctcatcaatcacaaccatggggtcaacaggttaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 22606 - DNA, 327 bp, Artificial
  MsCOMT deletion introduced by TALEN pair MsCOMT_T03.1
tctcacaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaaggttcagagactttatggtttggctactgttgctaa

SEQ ID NO: 22607 - DNA, 357 bp, Artificial
  MsCOMT deletion introduced by TALEN pair MsCOMT_T03.1
tctcacaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22608 - DNA, 205 bp, Artificial
  MsCOMT deletion introduced by TALEN pair MsCOMT_T03.1
tctcacaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaagattcagagactttatggtttggctactgttgctaa

SEQ ID NO: 22609 - DNA, 360 bp, Artificial
  MsCOMT deletion introduced by TALEN pair MsCOMT_T03.1
tctcacaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22610 - DNA, 357 bp, Artificial
  MsCOMT deletion introduced by TALEN pair MsCOMT_T03.1
tctcacaaaaccctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22611 - DNA, 356 bp, Artificial
  MsCOMT deletion introduced by TALEN pair MsCOMT_T03.1
tctcacaaaacccatcaatcacaaccatgggttcaacaggtgaaactcaaataacaccaacccacatatcagatgaagaagccaacctcttcgccatgcaattagcaagtgcttcagttcttcccatgattttaaaatcagcccttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22612 - DNA, 356 bp, Artificial
  MsCOMT deletion introduced by TALEN pair MsCOMT_T03.1
tctcacaaaacatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22613 - DNA, 434 bp, Artificial
  MsCOMT deletion introduced by TALEN pair MsCOMT_T03.1
tctcacaaaacactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaatcattgctaaagctggacctggtgctcaaatctcacctattgaaattgcttctcagctcccagccactcagccgcgggtttctggagtttaatgagctaagcacatacgtcagaaaccattatggcgcgttcaaaagtcactgatgcaccagttatgttggaccgaatggtgcgtctcttggcttgttacaatatcctcacttgttcagttcgtactcaacaagatggaaaggttcagagactgtatggtttggctactgttgctaa

SEQ ID NO: 22614 - DNA, 338 bp, Artificial
  MsCOMT deletion introduced by TALEN pair MsCOMT_T03.1
tctcacaaaaatctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttctgttcgtactcaacaagatggaaaggttcagagactttatggtttggctactgttgctaa

SEQ ID NO: 22615 - DNA, 355 bp, Artificial
  MsCOMT deletion introduced by TALEN pair MsCOMT_T03.1
tctcacaaaaatctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22616 - DNA, 360 bp, Artificial
  MsCOMT deletion introduced by TALEN pair MsCOMT_T03.1
tctcacaaaaatctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22617 - DNA, 270 bp, Artificial
  MsCOMT deletion introduced by TALEN pair MsCOMT_T03.1
tctcacaaaaatctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 22618 - DNA, 392 bp, Artificial
  MsCOMT deletion introduced by TALEN pair MsCOMT_T03.1
tctcacaaaaagctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22619 - DNA, 310 bp, Artificial
  MsCOMT deletion introduced by TALEN pair MsCOMT_T03.1
tctcacaaaaacttcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagtctttatggtttggctactgttgctaa

SEQ ID NO: 22620 - DNA, 358 bp, Artificial
  MsCOMT deletion introduced by TALEN pair MsCOMT_T03.1
tctcacaaaaacttcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22621 - DNA, 359 bp, Artificial
  MsCOMT deletion introduced by TALEN pair MsCOMT_T03.1
tctcacaaaaacttcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 22622 - DNA, 352 bp, Artificial
  MsCOMT deletion introduced by TALEN pair MsCOMT_T03.1
tctcacaaaaacttcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaaccagtcatgttggaccgaatgttgcgtctcttggcttgttacaatatcctcacttgttctgttcgtactcaacaagatggaaaggttcagagactttatggtttggctactgttgctaa

SEQ ID NO: 22623 - DNA, 358 bp, Artificial
  MsCOMT deletion introduced by TALEN pair MsCOMT_T03.1
tctcacaaaaacttcatcaatcacaaccatgggttcaacaggtgaaactcaaataacaccaacccacatatcagatgaagaagcaaacctcttcgccatgcaactagcaagtgcttcagttcttcccatgattttgaaatcagctcgtgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22624 - DNA, 358 bp, Artificial
  MsCOMT deletion introduced by TALEN pair MsCOMT_T03.1
tctcacaaaaactctcaatcacaaccatgggttcaacaggtgaaactcaaataacaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22625 - DNA, 358 bp, Artificial
  MsCOMT deletion introduced by TALEN pair MsCOMT_T03.1
tctcacaaaaactctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22626 - DNA, 354 bp, Artificial
  MsCOMT deletion introduced by TALEN pair MsCOMT_T03.1
tctcacaaaaactcctcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22627 - DNA, 314 bp, Artificial
  MsCOMT deletion introduced by TALEN pair MsCOMT_T03.1
tctcacaaaaactcctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22628 - DNA, 248 bp, Artificial
  MsCOMT deletion introduced by TALEN pair MsCOMT_T03.1
tctcacaaaaactcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaaggttcagagactttatggtttggctactgttgctaa

SEQ ID NO: 22629 - DNA, 358 bp, Artificial
  MsCOMT deletion introduced by TALEN pair MsCOMT_T03.1
tctcacaaaaactcatcaatcccaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22630 - DNA, 361 bp, Artificial
  MsCOMT deletion introduced by TALEN pair MsCOMT_T03.1
tctcacaaaaactcatcaatcacaaccatgggttcaacaggtgaaactccaatcacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22631 - DNA, 355 bp, Artificial
  MsCOMT deletion introduced by TALEN pair MsCOMT_T03.1
tctcacaaaaactcatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22632 - DNA, 359 bp, Artificial
  MsCOMT deletion introduced by TALEN pair MsCOMT_T03.1
tctcacaaaaactcatcaatcacaaccatgggttcaacaggtgaaactcagataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22633 - DNA, 361 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22634 - DNA, 357 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaagattcagagcctttatggtttggctactgttgctaa

SEQ ID NO: 22635 - DNA, 361 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22636 - DNA, 467 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcatctcttgaacttgatctcttagaaatcattgctaaagctggacctggtgctcaaatttcacctattgaaattgcttctcagctaccaacaactaaccaccctccgggccgttgcttcacaccgtgcaatccgctcccggcggatttgtcctactcaggagagcgttcaccgacaaacaacagataaaacgaaaggctcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22637 - DNA, 353 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttctgttcgtactcaacaagatggaaaggttcagagactttatggttggctactgttgctaa

SEQ ID NO: 22638 - DNA, 358 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22639 - DNA, 359 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22640 - DNA, 360 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 22641 - DNA, 360 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22642 - DNA, 357 bp, Artificial
  MsCOMT deletion introduced by TALEN pair MsCOMT_T03.1
tctcacaaaaactcatcaatcacaaccatgggttcaacaggtgaaactcaaatcacaccaacccacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22643 - DNA, 336 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22644 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtttcttggcttgttacaatatcctcacttgttcagttcgtactcaacaagatggaaaggttcagagactttatggtttggctactgttgctaa

SEQ ID NO: 22645 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttctcatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22646 - DNA, 430 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcatctcttgaacttgatctcttagaaatcattgctaaagctggacctggtgctcaaatttcacatattgaaattgcttctcagctaccaacaggagcaggtggtggccatcgccagcaataatggtggccagcagccgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22647 - DNA, 345 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgttcagttcgtactcaacaagatggaaaagttcagagactttatggtttggctactgttgctaa

SEQ ID NO: 22648 - DNA, 357 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22649 - DNA, 364 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22650 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgtgctaaa

SEQ ID NO: 22651 - DNA, 357 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22652 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaagattcagagactttatggtttggctactgttgctaa

SEQ ID NO: 22653 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22654 - DNA, 206 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctacaagatggaaagattcagagactttatggtttggctactgttgctaa

SEQ ID NO: 22655 - DNA, 247 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 22656 - DNA, 349 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22657 - DNA, 357 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 22658 - DNA, 352 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22659 - DNA, 355 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22660 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22661 - DNA, 357 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22662 - DNA, 343 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaaggttcagagactttatggtttggctactgttgctaa

SEQ ID NO: 22663 - DNA, 354 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22664 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22665 - DNA, 358 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22666 - DNA, 357 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22667 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22668 - DNA, 361 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22669 - DNA, 469 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaagcagcaacgatgttacgcagcagggcagtcgccctaaaacaaagttaaacattatgagggaagcggtgatcgccgaagtatcgactcaactatcagaggtagttggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22670 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22671 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22672 - DNA, 454 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaccccccagcaggtggtggccatcgccagcaataatggtggcaagcaggcgctggagacggtccagcggctgttgccggtgctgtgccaggcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22673 - DNA, 353 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22674 - DNA, 348 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22675 - DNA, 354 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22676 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22677 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 22678 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22679 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22680 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22681 - DNA, 411 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgacggatggcctttttgcgtttctacaaactcttcctggctagcggtaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 22682 - DNA, 358 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22683 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22684 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22685 - DNA, 206 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaagattcagagactttatggtttggctactgttgctaa

SEQ ID NO: 22686 - DNA, 408 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcatctcttgaacttgatctcttagaaatcattgctaaagctggacctggtactcaaatttcacctattgaaattgcttctcagctcccaacaactagccacgatggcggcaagcaggcgctggagacggtccagcggctgttctgatgcaccagttatgttggaccgaatgttgcgtctcttggcttgatacaatatcctcacttgttcagtgcgtactcaacaagatggaaaggttcagagactttatggtttggctactgttgctaa

SEQ ID NO: 22687 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22688 - DNA, 339 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaggttcagagactttatggtttggctactgttgctaa

SEQ ID NO: 22689 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22690 - DNA, 358 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22691 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22692 - DNA, 391 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22693 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22694 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagtgcgtactcaacgagatggaaagattcagagactttatggtttggctactgttgctaa

SEQ ID NO: 22695 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22696 - DNA, 353 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22697 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22698 - DNA, 358 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22699 - DNA, 354 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgctgcgtctcttggcttgttacaatatcctcacttgttcagttcgtactcaacaagatggaaaggttcagagactttatggtttggctactgttgctaa

SEQ ID NO: 22700 - DNA, 357 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22701 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22702 - DNA, 358 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22703 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22704 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgctccagttatgttggaccgaatgttgcgtctcttggcttgttacaatatcctcacttgttcagttcgtactcaacaagatggaaagattcagagactttatggtttggctactgttgctaa

SEQ ID NO: 22705 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22706 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 22707 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22708 - DNA, 361 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22709 - DNA, 362 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22710 - DNA, 367 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccccctgatgcaccagttatgttggaccgaatgttgcgtctcttggcttgttacaatatcctcacttgttcagttcgtactcaacaagatggaaaagttcagagactttatggtttggctactgtgctaa

SEQ ID NO: 22711 - DNA, 369 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22712 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22713 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22714 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 22715 - DNA, 351 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaagattcagagactttatggtttggctactgttgctaa

SEQ ID NO: 22716 - DNA, 357 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22717 - DNA, 353 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaagttcagagactttatggtttggctactgttgctaa

SEQ ID NO: 22718 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22719 - DNA, 259 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 22720 - DNA, 356 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22721 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatggtgcggcgcggggcgggggacaagagccgcacgggggaagggcggacgcaacaagagggaaaggtgcagagacgtgaggggttggctactgttgctaa

SEQ ID NO: 22722 - DNA, 359 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22723 - DNA, 427 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22724 - DNA, 360 bp, Artificial
  MsCOMT deletion introduced by TALEN pair MsCOMT_T03.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22725 - DNA, 329 bp, Artificial
  MsCOMT deletion introduced by TALEN pair MsCOMT_T03.1
tctcacaaaaactcatcaatcacaaccatgggttcaacaggagaaactcaaataacaccaacccacatatcagatgaagaagcaaacctcttcgccattcaattagcaagtgcttcagttcttcccatgattttaatatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaaagttcagagactttatggtttggctactgttgctaa

SEQ ID NO: 22726 - DNA, 360 bp, Artificial
  MsCOMT deletion introduced by TALEN pair MsCOMT_T03.1
tctcacaaaaactatcaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22727 - DNA, 357 bp, Artificial
  MsCOMT deletion introduced by TALEN pair MsCOMT_T03.1
tctcacaaaaactatcaatcacaaccatgggttcaacaggtgaaactcaaataacaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22728 - DNA, 360 bp, Artificial
  MsCOMT deletion introduced by TALEN pair MsCOMT_T03.1
tctcacaaaaaccttcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgatgcaccagttatgttggaccgaatgttgcgtctcttggcttgttacaatatcctcacttgttctgttcgtactcaacaagatggaaagattcagagactttatggtttggctactgttgctaa

SEQ ID NO: 22729 - DNA, 354 bp, Artificial
  MsCOMT deletion introduced by TALEN pair MsCOMT_T03.1
tctcacaaaaaccttcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22730 - DNA, 353 bp, Artificial
  MsCOMT deletion introduced by TALEN pair MsCOMT_T03.1
tctcacaaaaaccttcaatcacaaccatgggttcaacaggtgcaactcaaataacaccaacccacatatcagatgaagaagccaacctcttcgccatacaactagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22731 - DNA, 351 bp, Artificial
  MsCOMT deletion introduced by TALEN pair MsCOMT_T03.1
tctcacaaaaaccttcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22732 - DNA, 360 bp, Artificial
  MsCOMT deletion introduced by TALEN pair MsCOMT_T03.1
tctcacaaaaaccttatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22733 - DNA, 360 bp, Artificial
  MsCOMT deletion introduced by TALEN pair MsCOMT_T03.1
tctcacaaaaaccttatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22734 - DNA, 359 bp, Artificial
  MsCOMT deletion introduced by TALEN pair MsCOMT_T03.1
tctcacaaaaaccttatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22735 - DNA, 361 bp, Artificial
  MsCOMT deletion introduced by TALEN pair MsCOMT_T03.1
tctcacaaaaaccttatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22736 - DNA, 356 bp, Artificial
  MsCOMT deletion introduced by TALEN pair MsCOMT_T03.1
tctcacaaaaaccttatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22737 - DNA, 396 bp, Artificial
  MsCOMT deletion introduced by TALEN pair MsCOMT_T03.1
tctcacaaaaacctgatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22738 - DNA, 360 bp, Artificial
  MsCOMT deletion introduced by TALEN pair MsCOMT_T03.1
tctcacaaaaacctgatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22739 - DNA, 358 bp, Artificial
  MsCOMT deletion introduced by TALEN pair MsCOMT_T03.1
tctcacaaaaacctcttcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22740 - DNA, 361 bp, Artificial
  MsCOMT deletion introduced by TALEN pair MsCOMT_T03.1
tctcacaaaaacctcttcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaaggttcagagcctttatggtttggcgactgttgctaa

SEQ ID NO: 22741 - DNA, 359 bp, Artificial
  MsCOMT deletion introduced by TALEN pair MsCOMT_T03.1
tctcacaaaaacctcttcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 22742 - DNA, 357 bp, Artificial
  MsCOMT deletion introduced by TALEN pair MsCOMT_T03.1
tctcacaaaaacctctcaatcccaaccatgggttcaacaggtgaaactccaataacaccaacccacatatcagatgaagaagcaaacctcttcgccatgcaactaacaagttcttcagttcttcccatgattttgaaatcatctcttgaacttgatctcttagaaatcattgctaaagctggacctggtgctcaaatttcacctagtgaaattgcttctcaactcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22743 - DNA, 354 bp, Artificial
  MsCOMT deletion introduced by TALEN pair MsCOMT_T03.1
tctcacaaaaacctctcaatcacaaccatgggttcaacagttgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgattgttgcgtctcttggcttgttacaatatcctcacttgttcagttcgtactcaacaagatggaaatgttcagagcctttatggtttggctactgttgctaa

SEQ ID NO: 22744 - DNA, 359 bp, Artificial
  MsCOMT deletion introduced by TALEN pair MsCOMT_T03.1
tctcacaaaaacctctcaatcacaaccatgggttcaacaggtgaaacttaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22745 - DNA, 355 bp, Artificial
  MsCOMT deletion introduced by TALEN pair MsCOMT_T03.1
tctcacaaaaacctctcaatcacaaccatgggttcaacaggtgaaactccaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 22746 - DNA, 357 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22747 - DNA, 360 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggactgaatgttgcgtctcttggcttgttacaatatcctcacctgttcagttcgtactcaacaagatggaaagattcagagactttatggtttggctactgttgctaa

SEQ ID NO: 22748 - DNA, 354 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22749 - DNA, 355 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggagagattcagagactttatggtttggcactgttgctaa

SEQ ID NO: 22750 - DNA, 361 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22751 - DNA, 359 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22752 - DNA, 354 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22753 - DNA, 362 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22754 - DNA, 359 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggctggttacaatatcctcacttgttcagttcgtactcaacaagatggaaaggttcagagactttattgtttggctactgttgctaa

SEQ ID NO: 22755 - DNA, 361 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22756 - DNA, 352 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22757 - DNA, 360 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22758 - DNA, 359 bp, Artificial
  MsCOMT deletion introduced by TALEN pair MsCOMT_T03.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22759 - DNA, 362 bp, Artificial
  MsCOMT deletion introduced by TALEN pair MsCOMT_T03.1
tctcacaaaaacctctcaatcacaaccatgggttcaacaggtgaaactcaaataactccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22760 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22761 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22762 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22763 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22764 - DNA, 393 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcatctattgaaattgcttctcagctaccaacaactaacaccattattgctgacgatggccaccaaccctgatgcaccatttatgttggaccgaatgttgcgtctcttggcttgttacaatatcctcacttgttcagttcgtactcaacaagatggaaaggttcagagactttatggtttggctactgtagataa

SEQ ID NO: 22765 - DNA, 354 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 22766 - DNA, 344 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaaggttcagagactttatggtttggctactgttgctaa

SEQ ID NO: 22767 - DNA, 357 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22768 - DNA, 346 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttctgttcgtactcaacaagatggaaaggttcagagactttatggtttggctactgttgctaa

SEQ ID NO: 22769 - DNA, 358 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22770 - DNA, 357 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22771 - DNA, 349 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22772 - DNA, 356 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttgggccgaatgttgcgtctcttggcttgttacaatatcctcacttgttcagttcgtactcaacaagatggaaagattcagagactttatggtttggctactgttgctaa

SEQ ID NO: 22773 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22774 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22775 - DNA, 355 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22776 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22777 - DNA, 335 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaagattcagagactttatggtttggctactgttgctaa

SEQ ID NO: 22778 - DNA, 358 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22779 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttgccttgttacaatatcctcacttgttcagttcgtactcaacaagatggaaaagttcagagactttatggtttggctactgttgctaa

SEQ ID NO: 22780 - DNA, 361 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22781 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22782 - DNA, 358 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22783 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22784 - DNA, 351 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaagattcagagactttatggtttggctactgttgctaa

SEQ ID NO: 22785 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22786 - DNA, 269 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaacaagatggaaaggttcagagactttatggtttggctactgttgctaa

SEQ ID NO: 22787 - DNA, 356 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccaggtgctcaaatttcacctattgaaattgcttctcagctcccaacaaatgcaccagttatgttggaccgaatgttgcgtctcttggcttgttacaatatcctcactttttcagttcgtactcaacaagatggaaaggttcagagactttatggtttggctactgttgctaa

SEQ ID NO: 22788 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgacctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22789 - DNA, 311 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaattaacaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 22790 - DNA, 358 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcatctcttgaacttgatctcttagaaatcattgctaaagctggacctggtgctcaaatttcacctattgaaattgcttctcagctaccaacactgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 22791 - DNA, 266 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 22792 - DNA, 354 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22793 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22794 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22795 - DNA, 356 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22796 - DNA, 358 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22797 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22798 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22799 - DNA, 459 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaatgaaaaggggcagccgccacccatgaaatatataggacccctataggactcatgtgcatattaaccgtttgccacccatgctttcatatccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22800 - DNA, 366 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22801 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22802 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22803 - DNA, 361 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22804 - DNA, 351 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22805 - DNA, 354 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22806 - DNA, 354 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22807 - DNA, 356 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22808 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22809 - DNA, 359 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagagggaaaggttcagagactttatggtttggctactgttgctaa

SEQ ID NO: 22810 - DNA, 361 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22811 - DNA, 361 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22812 - DNA, 269 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggttactgttgctaa

SEQ ID NO: 22813 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcgcaaatttcacctattgaaattgcttctcagctaccaacaacttgatgcaccaggtatgttggaccgaatggtgcgtctcttggctggttacaatagcctcacttgttcagttcgtactcagcaagatggaaagattcagagacgttagggtgtggctactggggctaa

SEQ ID NO: 22814 - DNA, 309 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22815 - DNA, 298 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 22816 - DNA, 357 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22817 - DNA, 360 bp, Artificial
  MsCOMT deletion introduced by TALEN pair MsCOMT_T03.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctatcgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22818 - DNA, 276 bp, Artificial
  MsCOMT deletion introduced by TALEN pair MsCOMT_T03.1
tctcacaaaaacctctcaatcacaaccatgggttcaacaggcgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 22819 - DNA, 355 bp, Artificial
  MsCOMT deletion introduced by TALEN pair MsCOMT_T03.1
tctcacaaaaacctctcaatcacaaccatgggctcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22820 - DNA, 360 bp, Artificial
  MsCOMT deletion introduced by TALEN pair MsCOMT_T03.1
tctcacaaaaacctcgtcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22821 - DNA, 360 bp, Artificial
  MsCOMT deletion introduced by TALEN pair MsCOMT_T03.1
tctcacaaaaacctcgtcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22822 - DNA, 362 bp, Artificial
  MsCOMT deletion introduced by TALEN pair MsCOMT_T03.1
tctcacaaaaacctccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22823 - DNA, 356 bp, Artificial
  MsCOMT deletion introduced by TALEN pair MsCOMT_T03.1
tctcacaaaaacctccaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22824 - DNA, 358 bp, Artificial
  MsCOMT deletion introduced by TALEN pair MsCOMT_T03.1
tctcacaaaaacctccaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22825 - DNA, 359 bp, Artificial
  MsCOMT deletion introduced by TALEN pair MsCOMT_T03.1
tctcacaaaaacctcattcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22826 - DNA, 361 bp, Artificial
  MsCOMT deletion introduced by TALEN pair MsCOMT_T03.1
tctcacaaaaacctcattaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22827 - DNA, 321 bp, Artificial
  MsCOMT deletion introduced by TALEN pair MsCOMT_T03.1
tctcacaaaaacctcattaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctccttatgcaccagttatgttggaccgaatgttgcgtctcttggcttgttacaatatcctcacttgttcagttcgtactcaacaagatggaaagattcagatactttatggtttggctactgttgctaa

SEQ ID NO: 22828 - DNA, 342 bp, Artificial
  MsCOMT deletion introduced by TALEN pair MsCOMT_T03.1
tctcacaaaaacctcattaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatatcttagaaatcattgctaaagctggacatagtgctcaaatttcccctattgaaattgcttctcagctaccaacgttggaccgaatgttgcgtctcttggcttgttacaatatcctcacttgttcagttcgtactcaacaagatggaaaggttcagagactttatggtttggctactgttgctaa

SEQ ID NO: 22829 - DNA, 360 bp, Artificial
  MsCOMT deletion introduced by TALEN pair MsCOMT_T03.1
tctcacaaaaacctcatgaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcaaagactttatggtttggctactgttgctaa

SEQ ID NO: 22830 - DNA, 358 bp, Artificial
  MsCOMT deletion introduced by TALEN pair MsCOMT_T03.1
tctcacaaaaacctcatgaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22831 - DNA, 360 bp, Artificial
  MsCOMT deletion introduced by TALEN pair MsCOMT_T03.1
tctcacaaaaacctcatctatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22832 - DNA, 360 bp, Artificial
  MsCOMT deletion introduced by TALEN pair MsCOMT_T03.1
tctcacaaaaacctcatctatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22833 - DNA, 355 bp, Artificial
  MsCOMT deletion introduced by TALEN pair MsCOMT_T03.1
tctcacaaaaacctcatctatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 22834 - DNA, 370 bp, Artificial
  MsCOMT deletion introduced by TALEN pair MsCOMT_T03.1
tctcacaaaaacctcatctatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22835 - DNA, 361 bp, Artificial
  MsCOMT deletion introduced by TALEN pair MsCOMT_T03.1
tctcacaaaaacctcatctatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22836 - DNA, 312 bp, Artificial
  MsCOMT deletion introduced by TALEN pair MsCOMT_T03.1
tctcacaaaaacctcatctatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 22837 - DNA, 362 bp, Artificial
  MsCOMT deletion introduced by TALEN pair MsCOMT_T03.1
tctcacaaaaacctcatctatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22838 - DNA, 356 bp, Artificial
  MsCOMT deletion introduced by TALEN pair MsCOMT_T03.1
tctcacaaaaacctcatcgatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22839 - DNA, 362 bp, Artificial
  MsCOMT deletion introduced by TALEN pair MsCOMT_T03.1
tctcacaaaaacctcatcgatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22840 - DNA, 359 bp, Artificial
  MsCOMT deletion introduced by TALEN pair MsCOMT_T03.1
tctcacaaaaacctcatcgatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctagacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 22841 - DNA, 360 bp, Artificial
  MsCOMT deletion introduced by TALEN pair MsCOMT_T03.1
tctcacaaaaacctcatcgatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22842 - DNA, 358 bp, Artificial
  MsCOMT deletion introduced by TALEN pair MsCOMT_T03.1
tctcacaaaaacctcatccatcacaaccatgggttcaacaggtgaaactcaaataacaccaacccacatatcagatgaagaagcaaacctcttcgccatgcaattagcaagtgcttcagttcttcccatgattttgaaatcagctcttgaacttgcattcttagaaatcattgctaaagatggacctggtgctcaaatttcacctattgaaattgcttctcagctaccaacaactaactccagttatgttggaccgaatgttgcgtctctgggcttgttacaatatcctcacttgttgagttcgtactcaacaagatggaaagtttcagagactttattgtttggctactggtgctaa

SEQ ID NO: 22843 - DNA, 365 bp, Artificial
  MsCOMT deletion introduced by TALEN pair MsCOMT_T03.1
tctcacaaaaacctcatccatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagttatgttggaccgaatgttgcgtctcttggcttgttacaatatcctcacttgttcagttcgtacgcaacaagatggaaaggttcagagacgttatggtttggcgactgttgctaa

SEQ ID NO: 22844 - DNA, 270 bp, Artificial
  MsCOMT deletion introduced by TALEN pair MsCOMT_T03.1
tctcacaaaaacctcatccatcacaaccatgagttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcacctattgaaattgcttctcaacaagatggaaaagttcagagactttatggtttggcgactgttgctaa

SEQ ID NO: 22845 - DNA, 362 bp, Artificial
  MsCOMT deletion introduced by TALEN pair MsCOMT_T03.1
tctcacaaaaacctcatccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22846 - DNA, 355 bp, Artificial
  MsCOMT deletion introduced by TALEN pair MsCOMT_T03.1
tctcacaaaaacctcatcattcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22847 - DNA, 357 bp, Artificial
  MsCOMT deletion introduced by TALEN pair MsCOMT_T03.1
tctcacaaaaacctcatcattcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22848 - DNA, 355 bp, Artificial
  MsCOMT deletion introduced by TALEN pair MsCOMT_T03.1
tctcacaaaaacctcatcattcacaaccacgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttctgttcgtactcaacaagatggaaaggttcagagactttatggtttggctactgttgctaa

SEQ ID NO: 22849 - DNA, 359 bp, Artificial
  MsCOMT deletion introduced by TALEN pair MsCOMT_T03.1
tctcacaaaaacctcatcatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22850 - DNA, 356 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22851 - DNA, 331 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttggctactgttgctaa

SEQ ID NO: 22852 - DNA, 361 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaagttcagagactttatggtttggctactgttactaa

SEQ ID NO: 22853 - DNA, 357 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22854 - DNA, 359 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22855 - DNA, 360 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22856 - DNA, 361 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22857 - DNA, 356 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22858 - DNA, 355 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22859 - DNA, 361 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22860 - DNA, 359 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22861 - DNA, 355 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22862 - DNA, 359 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22863 - DNA, 361 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22864 - DNA, 340 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 22865 - DNA, 360 bp, Artificial
  MsCOMT deletion introduced by TALEN pair MsCOMT_T03.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22866 - DNA, 360 bp, Artificial
  MsCOMT deletion introduced by TALEN pair MsCOMT_T03.1
tctcacaaaaacctcatcatcacaacaatgggttcaacaggtgaaactcaaataacaccaacccacatatcagatgaagaagcaaacctcttcgccatgcaactagcaagtgcttcagttcttcccatgattttaaaatcagctcttgtacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22867 - DNA, 360 bp, Artificial
  MsCOMT deletion introduced by TALEN pair MsCOMT_T03.1
tctcacaaaaacctcatcagtcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22868 - DNA, 362 bp, Artificial
  MsCOMT deletion introduced by TALEN pair MsCOMT_T03.1
tctcacaaaaacctcatcagtcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22869 - DNA, 447 bp, Artificial
  MsCOMT deletion introduced by TALEN pair MsCOMT_T03.1
tctcacaaaaacctcatcagtcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactacatacgtcagaaaccattattgcgcgttcaaaagtcgcctaaggtcactatcagctagcaaatatttcttgtcaaaaatgctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22870 - DNA, 312 bp, Artificial
  MsCOMT deletion introduced by TALEN pair MsCOMT_T03.1
tctcacaaaaacctcatcaattacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 22871 - DNA, 277 bp, Artificial
  MsCOMT deletion introduced by TALEN pair MsCOMT_T03.1
tctcacaaaaacctcatcaattacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 22872 - DNA, 362 bp, Artificial
  MsCOMT deletion introduced by TALEN pair MsCOMT_T03.1
tctcacaaaaacctcatcaattacaaccatgggttcaacaggtgaaactcaaataacaccaacccacatatcagatgaagaagcaaacctcttcgccatgcaactagcaagtgcttcagttcttcccatgattttgaaatcagctcttcaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22873 - DNA, 356 bp, Artificial
  MsCOMT deletion introduced by TALEN pair MsCOMT_T03.1
tctcacaaaaacctcatcaattacaaacatgggttcaacaggggaaactcaaataacaccaacccaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgtttcgtctcttggcttgttacaatatcctcacttgttcagttcgtactcaacaagatggaaaggttcagagactttatggtttggctactgttgctaa

SEQ ID NO: 22874 - DNA, 321 bp, Artificial
  MsCOMT deletion introduced by TALEN pair MsCOMT_T03.1
tctcacaaaaacctcatcaatctcaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22875 - DNA, 248 bp, Artificial
  MsCOMT deletion introduced by TALEN pair MsCOMT_T03.1
tctcacaaaaacctcatcaatctcaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 22876 - DNA, 361 bp, Artificial
  MsCOMT deletion introduced by TALEN pair MsCOMT_T03.1
tctcacaaaaacctcatcaatctcaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22877 - DNA, 360 bp, Artificial
  MsCOMT deletion introduced by TALEN pair MsCOMT_T03.1
tctcacaaaaacctcatcaatctcaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22878 - DNA, 355 bp, Artificial
  MsCOMT deletion introduced by TALEN pair MsCOMT_T03.1
tctcacaaaaacctcatcaatctcaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22879 - DNA, 360 bp, Artificial
  MsCOMT deletion introduced by TALEN pair MsCOMT_T03.1
tctcacaaaaacctcatcaatctcaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22880 - DNA, 356 bp, Artificial
  MsCOMT deletion introduced by TALEN pair MsCOMT_T03.1
tctcacaaaaacctcatcaatctcaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22881 - DNA, 413 bp, Artificial
  MsCOMT deletion introduced by TALEN pair MsCOMT_T03.1
tctcacaaaaacctcatcaatctcaaccatggcttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagcaccggcaccagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22882 - DNA, 355 bp, Artificial
  MsCOMT deletion introduced by TALEN pair MsCOMT_T03.1
tctcacaaaaacctcatcaatcgcaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22883 - DNA, 341 bp, Artificial
  MsCOMT deletion introduced by TALEN pair MsCOMT_T03.1
tctcacaaaaacctcatcaatcgcaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 22884 - DNA, 356 bp, Artificial
  MsCOMT deletion introduced by TALEN pair MsCOMT_T03.1
tctcacaaaaacctcatcaatcgcaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22885 - DNA, 207 bp, Artificial
  MsCOMT deletion introduced by TALEN pair MsCOMT_T03.1
tctcacaaaaacctcatcaatcccaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaagattcagagactttatggtttggctactgttgctaa

SEQ ID NO: 22886 - DNA, 357 bp, Artificial
  MsCOMT deletion introduced by TALEN pair MsCOMT_T03.1
tctcacaaaaacctcatcaatcccaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22887 - DNA, 207 bp, Artificial
  MsCOMT deletion introduced by TALEN pair MsCOMT_T03.1
tctcacaaaaacctcatcaatcccaaccatgggttcaacaggtgaaactcaaataacaccaacccacatatcagatgaagaagcaaacctcttcgccatgcaactagcaagtgcttcagttcttcccatgattttgaaatcagctcttgaacttgatctacaagatggaaagattcagagactttatggtttggctactgttgctaa

SEQ ID NO: 22888 - DNA, 358 bp, Artificial
  MsCOMT deletion introduced by TALEN pair MsCOMT_T03.1
tctcacaaaaacctcatcaatcccaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22889 - DNA, 360 bp, Artificial
  MsCOMT deletion introduced by TALEN pair MsCOMT_T03.1
tctcacaaaaacctcatcaatcataaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22890 - DNA, 356 bp, Artificial
  MsCOMT deletion introduced by TALEN pair MsCOMT_T03.1
tctcacaaaaacctcatcaatcataaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22891 - DNA, 355 bp, Artificial
  MsCOMT deletion introduced by TALEN pair MsCOMT_T03.1
tctcacaaaaacctcatcaatcataaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22892 - DNA, 321 bp, Artificial
  MsCOMT deletion introduced by TALEN pair MsCOMT_T03.1
tctcacaaaaacctcatcaatcataaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22893 - DNA, 359 bp, Artificial
  MsCOMT deletion introduced by TALEN pair MsCOMT_T03.1
tctcacaaaaacctcatcaatcataaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22894 - DNA, 360 bp, Artificial
  MsCOMT deletion introduced by TALEN pair MsCOMT_T03.1
tctcacaaaaacctcatcaatcataaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttcgaccgaatgttgcgtctcttggcttgttacaatatcctcacttgttcagttcgtactcaacaagatggaaaggttcagagactttatggtttggctactgttgctaa

SEQ ID NO: 22895 - DNA, 310 bp, Artificial
  MsCOMT deletion introduced by TALEN pair MsCOMT_T03.1
tctcacaaaaacctcatcaatcataaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcgtctcttggcttgttacaatatcctcacttgttcagttcgtactcaacaagatggaaagattcagagactttatggtttggctactgttgctaa

SEQ ID NO: 22896 - DNA, 321 bp, Artificial
  MsCOMT deletion introduced by TALEN pair MsCOMT_T03.1
tctcacaaaaacctcatcaatcactaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22897 - DNA, 353 bp, Artificial
  MsCOMT deletion introduced by TALEN pair MsCOMT_T03.1
tctcacaaaaacctcatcaatcactaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22898 - DNA, 359 bp, Artificial
  MsCOMT deletion introduced by TALEN pair MsCOMT_T03.1
tctcacaaaaacctcatcaatcactaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22899 - DNA, 361 bp, Artificial
  MsCOMT deletion introduced by TALEN pair MsCOMT_T03.1
tctcacaaaaacctcatcaatcacgggcaggggttcaacgggtgaaactcaaataacaccaacccacatatcagatgaagaggcaaacctcttggccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22900 - DNA, 358 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22901 - DNA, 361 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22902 - DNA, 356 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaggttcagagactttatggtttggctactgttgctaa

SEQ ID NO: 22903 - DNA, 355 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22904 - DNA, 361 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22905 - DNA, 361 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22906 - DNA, 357 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22907 - DNA, 362 bp, Artificial
  MsCOMT deletion introduced by TALEN pair MsCOMT_T03.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22908 - DNA, 360 bp, Artificial
  MsCOMT deletion introduced by TALEN pair MsCOMT_T03.1
tctcacaaaaacctcatcaatcacgaccatgggttcaacaagtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22909 - DNA, 359 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22910 - DNA, 360 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaccctcttcgccatgcaattagcaagtgcttcagttcttcccatgattttaaaatcagctcttgcacttgatctcttagaaatcattgctaaagctggacctggtgctcaaatgtcacctattgaaattgcttctcagctcccaacaactgatgcaccagttatgttggaccgaatgttgcgtctcttggcgggttacaatatcctcacttgttcagttcgtactcaacaagatggaaagattcagagactttaaggtttggctactgttgctaa

SEQ ID NO: 22911 - DNA, 358 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22912 - DNA, 207 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaacctcttcgccatgcaattaacaagtgcttcagttcttcccattattttaaaatcagctcttgaacttgatctacaagattgaaagattcagagactgtatggtttggctactgttgctaa

SEQ ID NO: 22913 - DNA, 355 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtcgcttggcttggtacaatatccgcgcttgtgcggttcgtgctcaacaagatggaaaggttcagagactttatggtttggctactgttgctaa

SEQ ID NO: 22914 - DNA, 359 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctga

SEQ ID NO: 22915 - DNA, 361 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22916 - DNA, 349 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctatgcaccagttatgtttgaccgaatgttgcgtctcttggcttgttacaatgtcctcacatgttcagttcgtactcaacaagatggaaaggttcagagacattatggtttggctactgttgctaa

SEQ ID NO: 22917 - DNA, 357 bp, Artificial
  MsCOMT deletion introduced by TALEN pair MsCOMT_T03.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgctcctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22918 - DNA, 396 bp, Artificial
  MsCOMT deletion introduced by TALEN pair MsCOMT_T03.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22919 - DNA, 358 bp, Artificial
  MsCOMT deletion introduced by TALEN pair MsCOMT_T03.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22920 - DNA, 362 bp, Artificial
  MsCOMT deletion introduced by TALEN pair MsCOMT_T03.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22921 - DNA, 359 bp, Artificial
  MsCOMT deletion introduced by TALEN pair MsCOMT_T03.1
tctcacaaaaacctcatcaatcacacccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22922 - DNA, 344 bp, Artificial
  MsCOMT deletion introduced by TALEN pair MsCOMT_T03.1
tctcacaaaaacctcatcaatcacacccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaaggttcagagactttatggtttggctactgttgctaa

SEQ ID NO: 22923 - DNA, 358 bp, Artificial
  MsCOMT deletion introduced by TALEN pair MsCOMT_T03.1
tctcacaaaaacctcatcaatcacaatcatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22924 - DNA, 360 bp, Artificial
  MsCOMT deletion introduced by TALEN pair MsCOMT_T03.1
tctcacaaaaacctcatcaatcacaatcatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22925 - DNA, 350 bp, Artificial
  MsCOMT deletion introduced by TALEN pair MsCOMT_T03.1
tctcacaaaaacctcatcaatcacaatcatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattactaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22926 - DNA, 361 bp, Artificial
  MsCOMT deletion introduced by TALEN pair MsCOMT_T03.1
tctcacaaaaacctcatcaatcacaatcatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22927 - DNA, 350 bp, Artificial
  MsCOMT deletion introduced by TALEN pair MsCOMT_T03.1
tctcacaaaaacctcatcaatcacaatcatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22928 - DNA, 357 bp, Artificial
  MsCOMT deletion introduced by TALEN pair MsCOMT_T03.1
tctcacaaaaacctcatcaatcacaagcatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22929 - DNA, 357 bp, Artificial
  MsCOMT deletion introduced by TALEN pair MsCOMT_T03.1
tctcacaaaaacctcatcaatcacaactatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 22930 - DNA, 358 bp, Artificial
  MsCOMT deletion introduced by TALEN pair MsCOMT_T03.1
tctcacaaaaacctcatcaatcacaactatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22931 - DNA, 364 bp, Artificial
  MsCOMT deletion introduced by TALEN pair MsCOMT_T03.1
tctcacaaaaacctcatcaatcacaactatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22932 - DNA, 361 bp, Artificial
  MsCOMT deletion introduced by TALEN pair MsCOMT_T03.1
tctcacaaaaacctcatcaatcacaaccttgggttcaacaggtgaaactcaaataacaacaacccacatatcagatgaagaatcaaacctattcgccatgcaactagcaagtgcttcagttcttcccatgattttgaaatcagctcttgaacttgatctcttagaaatcattgctaaagctggacccagtgctcaaatttcacctattgacattgcttctccgctaccaacaacctgatgcaccagttatgttggaacgaatgttgcgtctcttggcttgttacaatatccacacttgttcagttcgtacccaacaagatggaaaagttcagagactgtatggtttgcctactgatgctaa

SEQ ID NO: 22933 - DNA, 355 bp, Artificial
  MsCOMT deletion introduced by TALEN pair MsCOMT_T03.1
tctcacaaaaacctcatcaatcacaaccgtgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22934 - DNA, 359 bp, Artificial
  MsCOMT deletion introduced by TALEN pair MsCOMT_T03.1
tctcacaaaaacctcatcaatcacaaccgtgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 22935 - DNA, 296 bp, Artificial
  MsCOMT deletion introduced by TALEN pair MsCOMT_T03.1
tctcacaaaaacctcatcaatcacaaccgtgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 22936 - DNA, 355 bp, Artificial
  MsCOMT deletion introduced by TALEN pair MsCOMT_T03.1
tctcacaaaaacctcatcaatcacaaccgtgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22937 - DNA, 360 bp, Artificial
  MsCOMT deletion introduced by TALEN pair MsCOMT_T03.1
tctcacaaaaacctcatcaatcacaaccgtgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22938 - DNA, 288 bp, Artificial
  MsCOMT deletion introduced by TALEN pair MsCOMT_T03.1
tctcacaaaaacctcatcaatcacaaccctgggttcaacaggtgcaactcaaataacaccaacccacataccagatgaagcagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaaggtggaaaggttcagagactggatagtttgggtactgtagcaa

SEQ ID NO: 22939 - DNA, 360 bp, Artificial
  MsCOMT deletion introduced by TALEN pair MsCOMT_T03.1
tctcacaaaaacctcatcaatcacaaccctgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacagtatcctctcttgttcagttcgtactcagcaagatggaaacgtccagagactttatggtttggctactcttgctaa

SEQ ID NO: 22940 - DNA, 360 bp, Artificial
  MsCOMT deletion introduced by TALEN pair MsCOMT_T03.1
tctcacaaaaacctcatcaatcacaaccctgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctctcttgttcagttcgtactcaacaagatggaaaagttcagagactttatggtttggctacggttgctaa

SEQ ID NO: 22941 - DNA, 365 bp, Artificial
  MsCOMT deletion introduced by TALEN pair MsCOMT_T03.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22942 - DNA, 361 bp, Artificial
  MsCOMT deletion introduced by TALEN pair MsCOMT_T03.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22943 - DNA, 365 bp, Artificial
  MsCOMT deletion introduced by TALEN pair MsCOMT_T03.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcccctattgaaattgcttctcagctaccaacaactaacctgatgcaccagttattttggaccgaatgttgcgtctcttggcttgttacaatatcctcacttgttcagttcgtactcaacaagatggaaaggttcagagactttatggtttggctactgttgctaa

SEQ ID NO: 22944 - DNA, 349 bp, Artificial
  MsCOMT deletion introduced by TALEN pair MsCOMT_T03.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22945 - DNA, 360 bp, Artificial
  MsCOMT deletion introduced by TALEN pair MsCOMT_T03.1
tctcacaaaaacctcatcaatcacaaccctgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22946 - DNA, 354 bp, Artificial
  MsCOMT deletion introduced by TALEN pair MsCOMT_T03.1
tctcacaaaaacctcatcaatcacaaccattggttcaacatgtgaaactcaaataacaccaacccacatatcagatgaagaagcacacctcttcgccatgcaactagcaagttcttcagttcttcccatgattttgaagtcagctcttgatcttgatttcttagaaatcattgctaaagctggacctggtgctcaaatttcacctattgaaattgcttctcagctacctgatacaacagttatgttggacagattgttgcgtctcttggcttgttacaatatcctcaattgttcagttcgtaatcaacaagatggaatggttcagagactttatggtttggctactgttgctaa

SEQ ID NO: 22947 - DNA, 355 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22948 - DNA, 360 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactactgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 22949 - DNA, 355 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22950 - DNA, 358 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22951 - DNA, 357 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22952 - DNA, 299 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaactagcgagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaagattcagagactttatggtttggctactgttgctaa

SEQ ID NO: 22953 - DNA, 355 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22954 - DNA, 340 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 22955 - DNA, 360 bp, Artificial
  MsCOMT deletion introduced by TALEN pair MsCOMT_T03.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22956 - DNA, 310 bp, Artificial
  MsCOMT deletion introduced by TALEN pair MsCOMT_T03.1
tctcacaaaaacctcatcaatcacaaccatgtgttcaacatgtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaagatagaaaggttcagagactttatggtttggctactgttgctaa

SEQ ID NO: 22957 - DNA, 356 bp, Artificial
  MsCOMT deletion introduced by TALEN pair MsCOMT_T03.1
tctcacaaaaacctcatcaatcacaaccatgtgttcaacaggtgaaactcaaataacaccaacccacatatcagatgaagaagtaaacctcttcgccatgcaattagcaagtgcttcagttcttcccatgattttaaaatcagctcttgaacttgatcccttagaaatcattgctaaagctggacctggtgctcaaatttcacctgttcaaattgcttctcagctcccaatgatgcaccagttatgttggaccgaatgttgcatctctgggcttgttacaatatcctcacttgttcagttcggactcaacaagatggaaagattcagagacttttttgtttggctactgttgcaaa

SEQ ID NO: 22958 - DNA, 358 bp, Artificial
  MsCOMT deletion introduced by TALEN pair MsCOMT_T03.1
tctcacaaaaacctcatcaatcacaaccatgtgttcaacaggtgaaactcaaataacaccaacccacatatcagatgaagaagcaaacctcttctccattcaattatcaagtgcttcagttcttcccattatttttaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22959 - DNA, 356 bp, Artificial
  MsCOMT deletion introduced by TALEN pair MsCOMT_T03.1
tctcacaaaaacctcatcaatcacaaccatgtgttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22960 - DNA, 362 bp, Artificial
  MsCOMT deletion introduced by TALEN pair MsCOMT_T03.1
tctcacaaaaacctcatcaatcacaaccatgtgttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22961 - DNA, 360 bp, Artificial
  MsCOMT deletion introduced by TALEN pair MsCOMT_T03.1
tctcacaaaaacctcatcaatcacaaccatgtgttcaacaggtgaaactcaaataacaccaacccacatatcagatgaagaagcaaacctcttcgccatgcaactagcaagtgcttcagttcttcccatgattttaaaatcagctctgaacttgatctcttagaaatcaatgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22962 - DNA, 350 bp, Artificial
  MsCOMT deletion introduced by TALEN pair MsCOMT_T03.1
tctcacaaaaacctcatcaatcacaaccatggtttcaacatgttaaactcaaataacaccaacccacatatcagatgaagaagcaaacctcttcgccatgcaactatcaagttcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaacatcctcacttgttcagtacgtactcaaccagatggaacgattcagagacttgatggtttggctactgttgctaa

SEQ ID NO: 22963 - DNA, 365 bp, Artificial
  MsCOMT deletion introduced by TALEN pair MsCOMT_T03.1
tctcacaaaaacctcatcaatcacaaccatggtttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatcgaccctgatgcaccagttatgttggaccgaatgttgcgtcacttggcttgttacaatatcctcacttgtgcagttcgtactcaacaagatggaaagattcagagactttatggtttggctactgtagctaa

SEQ ID NO: 22964 - DNA, 361 bp, Artificial
  MsCOMT deletion introduced by TALEN pair MsCOMT_T03.1
tctcacaaaaacctcatcaatcacaaccatggtttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22965 - DNA, 352 bp, Artificial
  MsCOMT deletion introduced by TALEN pair MsCOMT_T03.1
tctcacaaaaacctcatcaatcacaaccatggtttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctcccaacaaccagttatgttggaccgaatgttgcgtctattggcgtgttacaatatcctcacttgttcagttcgtactcaacaagatggaaagattcagagaatttatggtttggctactgttgctaa

SEQ ID NO: 22966 - DNA, 356 bp, Artificial
  MsCOMT deletion introduced by TALEN pair MsCOMT_T03.1
tctcacaaaaacctcatcaatcacaaccatggtttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22967 - DNA, 357 bp, Artificial
  MsCOMT deletion introduced by TALEN pair MsCOMT_T03.1
tctcacaaaaacctcatcaatcacaaccatggtttcaacaggggaaactcaaataacaccaacccacatatcagatcaagaagcaaacctcttcgccatgcaactagcaagtgcttctgctcttcccatgattttgaaatcagctcttgaacttgatctcttagaaatcattgctaaagctggacctcgtgctcaaatttaacctattgaaattgcttctcatctaccaactgatgcaccagttatgttggagcgaatgttgcgtctcttggcttgttacaatatcctaacttgttcagttcgtactcaacaagatggaaaggttcagagactttatggtttggataatgttgctaa

SEQ ID NO: 22968 - DNA, 359 bp, Artificial
  MsCOMT deletion introduced by TALEN pair MsCOMT_T03.1
tctcacaaaaacctcatcaatcacaaccatggttcaacaggtgaaactccaataacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgcaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22969 - DNA, 360 bp, Artificial
  MsCOMT deletion introduced by TALEN pair MsCOMT_T03.1
tctcacaaaaacctcatcaatcacaaccatgggtttaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22970 - DNA, 321 bp, Artificial
  MsCOMT deletion introduced by TALEN pair MsCOMT_T03.1
tctcacaaaaacctcatcaatcacaaccatgggtttaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaagattcagagactttatggtttggctactgttgctaa

SEQ ID NO: 22971 - DNA, 362 bp, Artificial
  MsCOMT deletion introduced by TALEN pair MsCOMT_T03.1
tctcacaaaaacctcatcaatcacaaccatgggtttaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22972 - DNA, 360 bp, Artificial
  MsCOMT deletion introduced by TALEN pair MsCOMT_T03.1
tctcacaaaaacctcatcaatcacaaccatgggttgaacaggtgaaactcaaataacaccaacccacatatcagatgaagaagcaaacctcttcgccatgcaactagcaagtgcttcagttcttcccatgattttgaaatcggctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22973 - DNA, 353 bp, Artificial
  MsCOMT deletion introduced by TALEN pair MsCOMT_T03.1
tctcacaaaaacctcatcaatcacaaccatgggttctacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 22974 - DNA, 347 bp, Artificial
  MsCOMT deletion introduced by TALEN pair MsCOMT_T03.1
tctcacaaaaacctcatcaatcacaaccatgggttctacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttctgttcgtactcaacaagatggaaagattcagagactttatggtttggctactgttgctaa

SEQ ID NO: 22975 - DNA, 357 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22976 - DNA, 361 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22977 - DNA, 360 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22978 - DNA, 360 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22979 - DNA, 360 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22980 - DNA, 361 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22981 - DNA, 362 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22982 - DNA, 349 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22983 - DNA, 350 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22984 - DNA, 352 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 22985 - DNA, 358 bp, Artificial
  MsCOMT deletion introduced by TALEN pair MsCOMT_T03.1
tctcacaaaaacctcatcaatcacaaccatgggttcgacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatctcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 22986 - DNA, 289 bp, Artificial
  MsCOMT deletion introduced by TALEN pair MsCOMT_T03.1
tctcacaaaaacctcatcaatcacaaccatgggttcatcaggtgaaattcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 22987 - DNA, 248 bp, Artificial
  MsCOMT deletion introduced by TALEN pair MsCOMT_T03.1
tctcacaaaaacctcatcaatcacaaccatgggttcatcaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 22988 - DNA, 360 bp, Artificial
  MsCOMT deletion introduced by TALEN pair MsCOMT_T03.1
tctcacaaaaacctcatcaatcacaaccatgggttcatcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22989 - DNA, 361 bp, Artificial
  MsCOMT deletion introduced by TALEN pair MsCOMT_T03.1
tctcacaaaaacctcatcaatcacaaccatgggttcatcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22990 - DNA, 360 bp, Artificial
  MsCOMT deletion introduced by TALEN pair MsCOMT_T03.1
tctcacaaaaacctcatcaatcacaaccatgggttcatcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22991 - DNA, 352 bp, Artificial
  MsCOMT deletion introduced by TALEN pair MsCOMT_T03.1
tctcacaaaaacctcatcaatcacaaccatgggttcatcaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22992 - DNA, 260 bp, Artificial
  MsCOMT deletion introduced by TALEN pair MsCOMT_T03.1
tctcacaaaaacctcatcaatcacaaccatgggttcatcaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 22993 - DNA, 360 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgatgaagcaaacctcttcgccacgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22994 - DNA, 340 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaagattcagagactttatggtttggctactgttgctaa

SEQ ID NO: 22995 - DNA, 352 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 22996 - DNA, 359 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22997 - DNA, 349 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaagattcagagactttatggtttggctactgttgctaa

SEQ ID NO: 22998 - DNA, 361 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 22999 - DNA, 413 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccaccgccattgctggcgatggccaccacctgctggggggtcaagccgtgggccttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23000 - DNA, 474 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcggctgttgccggtgctgtgccaggcccacggcttgaccccggagcaggtggtggccatcgactgccctgctgcgtaacatcgttgctgctccataacatcaaacatcgacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23001 - DNA, 362 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23002 - DNA, 361 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 23003 - DNA, 357 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23004 - DNA, 361 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23005 - DNA, 357 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23006 - DNA, 361 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcactcgttctgttcgtactcaacaagatggaaaggttcagagactttatggtttggctactgttgctaa

SEQ ID NO: 23007 - DNA, 356 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23008 - DNA, 353 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23009 - DNA, 358 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23010 - DNA, 364 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23011 - DNA, 361 bp, Artificial
  MsCOMT deletion introduced by TALEN pair MsCOMT_T03.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23012 - DNA, 360 bp, Artificial
  MsCOMT deletion introduced by TALEN pair MsCOMT_T03.1
tctcacaaaaacctcatcaatcacaaccatgggttcagcaggtgaaaatcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23013 - DNA, 359 bp, Artificial
  MsCOMT deletion introduced by TALEN pair MsCOMT_T03.1
tctcacaaaaacctcatcaatcacaaccatgggttcaccaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23014 - DNA, 360 bp, Artificial
  MsCOMT deletion introduced by TALEN pair MsCOMT_T03.1
tctcacaaaaacctcatcaatcacaaccatgggttcaccaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23015 - DNA, 358 bp, Artificial
  MsCOMT deletion introduced by TALEN pair MsCOMT_T03.1
tctcacaaaaacctcatcaatcacaaccatgggttcaccaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttgagttcgtactcaacaagatggaaaggttcagagactttatggtttggctactgttgctaa

SEQ ID NO: 23016 - DNA, 267 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctggaccgaatgttgcgtctcttggcttgttacaatatcctcacttgttcagttcgtactcaacaagatggaaaggttcagagacttaatggtttggctactgttgctaa

SEQ ID NO: 23017 - DNA, 331 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttgaaatcattgctaaagctggacctggtgctcaaatttcacctattgaaattgcttctcagctcccaacaacttgcgtctcttggcttgttacaatatcctcacttgttcagttcgtactcaacaagatggaaagattcagagactttatggtttggctactgttgctaa

SEQ ID NO: 23018 - DNA, 361 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcgaatttcacctattgaaattgcttctcagctcccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23019 - DNA, 357 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23020 - DNA, 360 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23021 - DNA, 361 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23022 - DNA, 355 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23023 - DNA, 296 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 23024 - DNA, 360 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23025 - DNA, 352 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 23026 - DNA, 357 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggataagttcagagactttatggtttggctactgttgctaa

SEQ ID NO: 23027 - DNA, 356 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23028 - DNA, 361 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23029 - DNA, 351 bp, Artificial
  MsCOMT deletion introduced by TALEN pair MsCOMT_T03.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 23030 - DNA, 353 bp, Artificial
  MsCOMT deletion introduced by TALEN pair MsCOMT_T03.1
tctcacaaaaacctcatcaatcacaaccatgggttcaagaggtgaaactcaaataacaccaacccacatatcagatgaagaagcaaacctcttcgccatgcaattagcaagtgcttcagttcttcccattatttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23031 - DNA, 358 bp, Artificial
  MsCOMT deletion introduced by TALEN pair MsCOMT_T03.1
tctcacaaaaacctcatcaatcacaaccatgggttcaagaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23032 - DNA, 361 bp, Artificial
  MsCOMT deletion introduced by TALEN pair MsCOMT_T03.1
tctcacaaaaacctcatcaatcacaaccatgggttcaagaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23033 - DNA, 361 bp, Artificial
  MsCOMT deletion introduced by TALEN pair MsCOMT_T03.1
tctcacaaaaacctcatcaatcacaaccatgggttcaagaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaatgcaccagttatgttggaccaaatgttgcgtctcttggcttgttacaatatcctcacttgttcagttcgtactcaacaagatggaaaggttcagagactttatggtttggctactgttgctaa

SEQ ID NO: 23034 - DNA, 361 bp, Artificial
  MsCOMT deletion introduced by TALEN pair MsCOMT_T03.1
tctcacaaaaacctcatcaatcacaaccatgggttcaactggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 23035 - DNA, 350 bp, Artificial
  MsCOMT deletion introduced by TALEN pair MsCOMT_T03.1
tctcacaaaaacctcatcaatcacaaccatgggttcaactggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23036 - DNA, 350 bp, Artificial
  MsCOMT deletion introduced by TALEN pair MsCOMT_T03.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23037 - DNA, 360 bp, Artificial
  MsCOMT deletion introduced by TALEN pair MsCOMT_T03.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23038 - DNA, 360 bp, Artificial
  MsCOMT deletion introduced by TALEN pair MsCOMT_T03.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 23039 - DNA, 360 bp, Artificial
  MsCOMT deletion introduced by TALEN pair MsCOMT_T03.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23040 - DNA, 423 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23041 - DNA, 353 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23042 - DNA, 359 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23043 - DNA, 351 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23044 - DNA, 353 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23045 - DNA, 357 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23046 - DNA, 360 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23047 - DNA, 358 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacaccagttatgttggaccgaatgttgcgtctcttggcttgttacaatatcctcacttgttcagttcgtcctcaacaagatggaaaggttcagagcctttatggtttggctactgttgctaa

SEQ ID NO: 23048 - DNA, 340 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23049 - DNA, 249 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaaggttcagagactttatggtttggctactgttgctaa

SEQ ID NO: 23050 - DNA, 296 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaaggttcagagactttatggtttggctactgttgctaa

SEQ ID NO: 23051 - DNA, 360 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23052 - DNA, 356 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23053 - DNA, 360 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23054 - DNA, 364 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23055 - DNA, 430 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacccacggcttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23056 - DNA, 440 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagaccaggaacaagcacatcaaccccaacgagtggtggaaggtgtacccctccagcgtgaccgagttcaagttcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23057 - DNA, 362 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23058 - DNA, 357 bp, Artificial
  MsCOMT deletion introduced by TALEN pair MsCOMT_T03.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23059 - DNA, 358 bp, Artificial
  MsCOMT deletion introduced by TALEN pair MsCOMT_T03.1
tctcacaaaaacctcatcaatcacaaccatgggttcaaccggtgaaactcaaataacaccaacccacatatcagatgaagaagcaaacctcttcgccctgcaactagcaagtgcttcagttcttcccatgattttaaaatcagctcttgaacttgatctcttagaaatcattgctaaagctggacctggtgctcacatttcacctattgaaattgcttctcagctcccaacaagatgcaccagttatgttggaccgaatgttgcggctcttggcttgttacaatatcctcacttgttcagttcgtactcaacaagatggaaaggttcagagactgtatggtttggctactgttgcgaa

SEQ ID NO: 23060 - DNA, 361 bp, Artificial
  MsCOMT deletion introduced by TALEN pair MsCOMT_T03.1
tctcacaaaaacctcatcaatcacaaccatgggttcaaccggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23061 - DNA, 247 bp, Artificial
  MsCOMT deletion introduced by TALEN pair MsCOMT_T03.1
tctcacaaaaacctcatcaatcacaaccatgggttcaacatgtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttgctactgttgctaa

SEQ ID NO: 23062 - DNA, 360 bp, Artificial
  MsCOMT deletion introduced by TALEN pair MsCOMT_T03.1
tctcacaaaaacctcatcaatcacaaccatgggttcaacatgtgaaactcaaataacaccaacccacatatcagatgaagaagcaaacctcttcgccatgcaactagcaagtgcttcagttcttcccatgattttgaaatcatctcttgaacttgatctcttagaaatcattgctaaagctctacctggtgctcaaatttcacctattgaaattgcttatcagctaccaacagctgattcaccagttatgttggacagaatgttgcgtctcttggcttgtgacaatatcctcacttgttcagttcgtactcaacaagatggaaaggttcagagactttatggtttggctactgttgctaa

SEQ ID NO: 23063 - DNA, 358 bp, Artificial
  MsCOMT deletion introduced by TALEN pair MsCOMT_T03.1
tctcacaaaaacctcatcaatcacaaccatgggttcaacatgtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcccacttgttcagttcgtactcaacaagatggaaaggttcagagactttatggtttggctactgttgctaa

SEQ ID NO: 23064 - DNA, 358 bp, Artificial
  MsCOMT deletion introduced by TALEN pair MsCOMT_T03.1
tctcacaaaaacctcatcaatcacaaccatgggttcaacatgtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23065 - DNA, 362 bp, Artificial
  MsCOMT deletion introduced by TALEN pair MsCOMT_T03.1
tctcacaaaaacctcatcaatcacaaccatgggttcaacatgtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23066 - DNA, 361 bp, Artificial
  MsCOMT deletion introduced by TALEN pair MsCOMT_T03.1
tctcacaaaaacctcatcaatcacaaccatgggttcaacatgtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23067 - DNA, 360 bp, Artificial
  MsCOMT deletion introduced by TALEN pair MsCOMT_T03.1
tctcacaaaaacctcatcaatcacaaccatgggttcaacagttgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtacccaacaagatggaaagattcagagactttatggtttggctactttgctaa

SEQ ID NO: 23068 - DNA, 357 bp, Artificial
  MsCOMT deletion introduced by TALEN pair MsCOMT_T03.1
tctcacaaaaacctcatcaatcacaaccatgggttcaacagttgaaactcaaataacaccaacccacatatcagatgaagaagcaaacctcttcgccatgcaactagcaagtgcttcagttcttcccattattttaaaatcagctcttgaacttgatctcttagaaatcattgctaaagctggaccttgtgctcaaatttcacctattgaaattgcttctcagctaccaaaaattgcaccagttatgttggaccgaatgttgcatctattggcttgttacaatatcctcacttgttcagttcatactcaacaagatggaaaggttcagagactttatggtttggttactgtggctaa

SEQ ID NO: 23069 - DNA, 357 bp, Artificial
  MsCOMT deletion introduced by TALEN pair MsCOMT_T03.1
tctcacaaaaacctcatcaatcacaaccatgggttcaacagttgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23070 - DNA, 355 bp, Artificial
  MsCOMT deletion introduced by TALEN pair MsCOMT_T03.1
tctcacaaaaacctcatcaatcacaaccatgggttcaacagttgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23071 - DNA, 360 bp, Artificial
  MsCOMT deletion introduced by TALEN pair MsCOMT_T03.1
tctcacaaaaacctcatcaatcacaaccatgggttcaacagttgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23072 - DNA, 358 bp, Artificial
  MsCOMT deletion introduced by TALEN pair MsCOMT_T03.1
tctcacaaaaacctcatcaatcacaaccatgggttcaacagtgaaactcaaataacaccaacccacatatcagatgaagaagcaaacctcttcgccatgcaattagcaaatgcttcagttcttcccatgattttaaaatcagctcttgaacttgatctcttagaaatcattgctaaaactggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23073 - DNA, 289 bp, Artificial
  MsCOMT deletion introduced by TALEN pair MsCOMT_T03.1
tctcacaaaaacctcatcaatcacaaccatgggttcaacaggttaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaagattcagagactttatggtttggctactgttgctaa

SEQ ID NO: 23074 - DNA, 361 bp, Artificial
  MsCOMT deletion introduced by TALEN pair MsCOMT_T03.1
tctcacaaaaacctcatcaatcacaaccatgggttcaacaggttaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23075 - DNA, 358 bp, Artificial
  MsCOMT deletion introduced by TALEN pair MsCOMT_T03.1
tctcacaaaaacctcatcaatcacaaccatgggttcaacaggttaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgtgcagttcgtactcaacaagatggaaaggttcagagactttatggtttggcactgttgctaa

SEQ ID NO: 23076 - DNA, 362 bp, Artificial
  MsCOMT deletion introduced by TALEN pair MsCOMT_T03.1
tctcacaaaaacctcatcaatcacaaccatgggttcaacaggttaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23077 - DNA, 358 bp, Artificial
  MsCOMT deletion introduced by TALEN pair MsCOMT_T03.1
tctcacaaaaacctcatcaatcacaaccatgggttcaacaggtgtaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23078 - DNA, 353 bp, Artificial
  MsCOMT deletion introduced by TALEN pair MsCOMT_T03.1
tctcacaaaaacctcatcaatcacaaccatgggttcaacaggtgtaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23079 - DNA, 329 bp, Artificial
  MsCOMT deletion introduced by TALEN pair MsCOMT_T03.1
tctcacaaaaacctcatcaatcacaaccatgggttcaacaggtgtaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23080 - DNA, 357 bp, Artificial
  MsCOMT deletion introduced by TALEN pair MsCOMT_T03.1
tctcacaaaaacctcatcaatcacaaccatgggttcaacaggtgtaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagtttgtactcaacaagatggaaaagttcagagactttatggtttggctactgttgctaa

SEQ ID NO: 23081 - DNA, 361 bp, Artificial
  MsCOMT deletion introduced by TALEN pair MsCOMT_T03.1
tctcacaaaaacctcatcaatcacaaccatgggttcaacaggtgtaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23082 - DNA, 350 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23083 - DNA, 361 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23084 - DNA, 350 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggagaggttcagagactttatggtttggctactgttgctaa

SEQ ID NO: 23085 - DNA, 361 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23086 - DNA, 360 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23087 - DNA, 362 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23088 - DNA, 359 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 23089 - DNA, 359 bp, Artificial
  MsCOMT deletion introduced by TALEN pair MsCOMT_T03.1
tctcacaaaaacctcatcaatcacaaccatgggttcaacaggtggaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttgaaccgaatgttgcgtctcttggcttgttacaatatcctcacttgttcagtgcgtactcaacaagatggaaagattcagagactttatggtttggctactgtagctaa

SEQ ID NO: 23090 - DNA, 235 bp, Artificial
  MsCOMT deletion introduced by TALEN pair MsCOMT_T03.1
tctcacaaaaacctcatcaatcacaaccatgggttcaacaggtgcaactcaaataacaccaacccacatatcagatgaagaagcaaacctcttcgccatgcaattagcaagtgcttcagttcttcccatgattttaaaatcagctcttggcttgttacaatatcctcacttgttctgttcgtactcaacaagatggaaaggttcagagactttatggtttggctactgttgctaa

SEQ ID NO: 23091 - DNA, 360 bp, Artificial
  MsCOMT deletion introduced by TALEN pair MsCOMT_T03.1
tctcacaaaaacctcatcaatcacaaccatgggttcaacaggtgcaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagtcatgttggatcgaatgttgcgtctcttggcttgttacaatatcctcacttgttctgttcgtactcaacaagatggaaaggttcagagactttatggtttggctactgttgctaa

SEQ ID NO: 23092 - DNA, 353 bp, Artificial
  MsCOMT deletion introduced by TALEN pair MsCOMT_T03.1
tctcacaaaaacctcatcaatcacaaccatgggttcaacaggtgatactcaaataacaccaacctacatatcagatgaagaagaaaacctatttgccatgcaactagcaagagcttcagatcttccgatgattttgaaatcagctcttgaacttgatctcttaggaatcattgctaaaactggacctggtgctcaaatttcgcctattgaaattgcttctcagctaccaacaaaccagttatgttggaccgaatgttgcgtctcttggcttgttacaatttcctcagttgttcagttcgtactcaacaagatggaatggttcagagattttatggtttggctactgttgctaa

SEQ ID NO: 23093 - DNA, 360 bp, Artificial
  MsCOMT deletion introduced by TALEN pair MsCOMT_T03.1
tctcacaaaaacctcatcaatcacaaccatgggttcaacaggtgatactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggcttctgttgctaa

SEQ ID NO: 23094 - DNA, 300 bp, Artificial
  MsCOMT deletion introduced by TALEN pair MsCOMT_T03.1
tctcacaaaaacctcatcaatcacaaccatgggttcaacaggtgatactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggctactgttgctaa

SEQ ID NO: 23095 - DNA, 357 bp, Artificial
  MsCOMT deletion introduced by TALEN pair MsCOMT_T03.1
tctcacaaaaacctcatcaatcacaaccatgggttcaacaggtgagactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgctaa

SEQ ID NO: 23096 - DNA, 358 bp, Artificial
  MsCOMT deletion introduced by TALEN pair MsCOMT_T03.1
tctcacaaaaacctcatcaatcacaaccatgggttcaacaggtgagactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23097 - DNA, 359 bp, Artificial
  MsCOMT deletion introduced by TALEN pair MsCOMT_T03.1
tctcacaaaaacctcatcaatcacaaccatgggttcaacaggtgagactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23098 - DNA, 394 bp, Artificial
  MsCOMT deletion introduced by TALEN pair MsCOMT_T03.1
tctcacaaaaacctcatcaatcacaaccatgggttcaacaggtgagactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23099 - DNA, 336 bp, Artificial
  MsCOMT deletion introduced by TALEN pair MsCOMT_T03.1
tctcacaaaaacctcatcaatcacaaccatgggttcaacaggtgagactcaaataacaccaacccacatatcagatgaagaagcaaaccccttcgccatgcaattagcaagtgcttcagttcttcccatgattttaaaatcagctcttgaacttgatctcttagaaatcattgctaaagctggacctggtgctcaaatttcacctgttcaaattgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23100 - DNA, 331 bp, Artificial
  MsCOMT deletion introduced by TALEN pair MsCOMT_T03.1
tctcacaaaaacctcatcaatcacaaccatgggttcaacaggtgagactcaaataacaccaacccacatatcagatgaagaagcaaaactcttcgccatgcaattagcaagtgcttcagttcttcccattattttaaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagactttatggtttggctactgttgctaa

SEQ ID NO: 23101 - DNA, 358 bp, Artificial
  MsCOMT deletion introduced by TALEN pair MsCOMT_T03.1
tctcacaaaaacctcatcaatcacaaccatgggttcaacaggtgaatctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23102 - DNA, 362 bp, Artificial
  MsCOMT deletion introduced by TALEN pair MsCOMT_T03.1
tctcacaaaaacctcatcaatcacaaccatgggttcaacaggtgaatctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23103 - DNA, 358 bp, Artificial
  MsCOMT deletion introduced by TALEN pair MsCOMT_T03.1
tctcacaaaaacctcatcaatcacaaccatgggttcaacaggtgaatctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 23104 - DNA, 358 bp, Artificial
  MsCOMT deletion introduced by TALEN pair MsCOMT_T03.1
tctcacaaaaacctcatcaatcacaaccatgggttcaacaggtgaagctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23105 - DNA, 361 bp, Artificial
  MsCOMT deletion introduced by TALEN pair MsCOMT_T03.1
tctcacaaaaacctcatcaatcacaaccatgggttcaacaggtgaagctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23106 - DNA, 351 bp, Artificial
  MsCOMT deletion introduced by TALEN pair MsCOMT_T03.1
tctcacaaaaacctcatcaatcacaaccatgggttcaacaggtgaagctcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23107 - DNA, 360 bp, Artificial
  MsCOMT deletion introduced by TALEN pair MsCOMT_T03.1
tctcacaaaaacctcatcaatcacaaccatgggttcaacaggtgaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23108 - DNA, 358 bp, Artificial
  MsCOMT deletion introduced by TALEN pair MsCOMT_T03.1
tctcacaaaaacctcatcaatcacaaccatgggttcaacaggtgaacctcaaataacaccaacccacatatcagatgaagaagcaaacctcttcgccatgcaattagcaagtgcttcagttcttcccatgattttaaaatcagctcttgaacttgatctcttagaaatcattgctaaagctggaccaggtgctcaaatttcacctattgaaattgcttctcagctcccaacaacatgcaccagttatgttggaccgaatgttacatctcttggcttgttacaatatcctcacttgttcagttcgtactcaacaagagggaaaggttcagagactttatggtttggctactgttgctaa

SEQ ID NO: 23109 - DNA, 315 bp, Artificial
  MsCOMT deletion introduced by TALEN pair MsCOMT_T03.1
tctcacaaaaacctcatcaatcacaaccatgggttcaacaggtgaacctcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtacgcaacaagatggaaaggttcagagactttatggtttggctactgtggctaa

SEQ ID NO: 23110 - DNA, 362 bp, Artificial
  MsCOMT deletion introduced by TALEN pair MsCOMT_T03.1
tctcacaaaaacctcatcaatcacaaccatgggttcaacaggtgaaattcaaataacaccaacccacttatcagatgaagaagaaaacctcttcgccatgcaactagcaagtgcttcagttcttcccatgattttgaaatcagctcttgaacttgatctcttagaaatcaatgttaaatcttgacctggtgctcaaatttcacctattgaagttgcttcttagctcccaacaaccctgatgcaccagttatgttggaacgaatgttgcgtctcttggcttgtttcaatatcctcgcttgttcagttcgtactcaacaagattgaaaggttcagagactttatggtttggctactgttgctaa

SEQ ID NO: 23111 - DNA, 354 bp, Artificial
  MsCOMT deletion introduced by TALEN pair MsCOMT_T03.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgctaa

SEQ ID NO: 23112 - DNA, 394 bp, Artificial
  MsCOMT deletion introduced by TALEN pair MsCOMT_T03.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttgaaataagctcttgaacttgatctcttagaaatcattgctaaagctggacctggtgatcaaatttcacctattgaaattgcttctcagctaccaacaactaaatccagcgcctgcgtgccgccagcgtggccctgatgcaccagttagtttggaccgaatgttgcgtcgcttggcttgctacaagatcctcacttgttcagttcctactcaacaaaatggaaagcttcagacactttatggtttggctactgttgctaa

SEQ ID NO: 23113 - DNA, 360 bp, Artificial
  MsCOMT deletion introduced by TALEN pair MsCOMT_T03.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23114 - DNA, 363 bp, Artificial
  MsCOMT deletion introduced by TALEN pair MsCOMT_T03.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23115 - DNA, 361 bp, Artificial
  MsCOMT deletion introduced by TALEN pair MsCOMT_T03.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 23116 - DNA, 356 bp, Artificial
  MsCOMT deletion introduced by TALEN pair MsCOMT_T03.1
tctcacaaaaacctcatcaatcacaaccatgggttcaacaggtgaaacttaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23117 - DNA, 360 bp, Artificial
  MsCOMT deletion introduced by TALEN pair MsCOMT_T03.1
tctcacaaaaacctcatcaatcacaaccatgggttcaacaggtgaaacttaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23118 - DNA, 361 bp, Artificial
  MsCOMT deletion introduced by TALEN pair MsCOMT_T03.1
tctcacaaaaacctcatcaatcacaaccatgggttcaacaggtgaaacttaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23119 - DNA, 360 bp, Artificial
  MsCOMT deletion introduced by TALEN pair MsCOMT_T03.1
tctcacaaaaacctcatcaatcacaaccatgggttcaacaggtgaaactgaaataacaccaacccacatatcagatgaagaagcaaacctcttcgccatgcaattagcaagtgcttcagttcttcccattattttaaaatcagctcttgaacttgatctcttagaaatcattgctaaagctggacctggtgctcacatttcacctattgaaattgcttctcagctaccaacaactgatgcaccagttatgttggacccaatgttgcgtctcttggcttgttacaatatcctcgcttgttcagttcgtactcaacaagatggaaagattcagagactttatggtttggctactgttgctaa

SEQ ID NO: 23120 - DNA, 391 bp, Artificial
  MsCOMT deletion introduced by TALEN pair MsCOMT_T03.1
tctcacaaaaacctcatcaatcacaaccatgggttcaacaggtgaaactctaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggcacagcaccggcaacagccgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23121 - DNA, 360 bp, Artificial
  MsCOMT deletion introduced by TALEN pair MsCOMT_T03.1
tctcacaaaaacctcatcaatcacaaccatgggttcaacaggtgaaactctaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23122 - DNA, 361 bp, Artificial
  MsCOMT deletion introduced by TALEN pair MsCOMT_T03.1
tctcacaaaaacctcatcaatcacaaccatgggttcaacaggtgaaactctaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23123 - DNA, 356 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23124 - DNA, 395 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23125 - DNA, 355 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23126 - DNA, 353 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23127 - DNA, 334 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaactagcaagtgcttcagttcttcgcatgattttgaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23128 - DNA, 334 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaatgcaccagttatgttggaccgaatgttgcgtctcttggcttattacaatatcctcacttgttcagttcgtactcaacaagatggaaaggttcagagactttatggtttggctactgttgctaa

SEQ ID NO: 23129 - DNA, 349 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaagattcagagactttatggtttggctactgttgctaa

SEQ ID NO: 23130 - DNA, 333 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaggttcagagactttatggtttggctactgttgcaa

SEQ ID NO: 23131 - DNA, 359 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23132 - DNA, 350 bp, Artificial
  MsCOMT deletion introduced by TALEN pair MsCOMT_T03.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23133 - DNA, 359 bp, Artificial
  MsCOMT deletion introduced by TALEN pair MsCOMT_T03.1
tctcacaaaaacctcatcaatcacaaccatgggttcaacaggtgaaactccaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaattttgcgtctcttggcttgttacaatatcctcacttgttcagttcgtactcaacaagatggaaagattcagagactttatggtttggctactgttgctaa

SEQ ID NO: 23134 - DNA, 352 bp, Artificial
  MsCOMT deletion introduced by TALEN pair MsCOMT_T03.1
tctcacaaaaacctcatcaatcacaaccatgggttcaacaggtgaaactcatataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23135 - DNA, 474 bp, Artificial
  MsCOMT deletion introduced by TALEN pair MsCOMT_T03.1
tctcacaaaaacctcatcaatcacaaccatgggttcaacaggtgaaactcatataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccggagcaggtggtggccatcgccagccacgatggcggcaagcaggcgctggagacggtccagcggctgttgccggtgctgtgccaggcccacggcttgaccccccagctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23136 - DNA, 361 bp, Artificial
  MsCOMT deletion introduced by TALEN pair MsCOMT_T03.1
tctcacaaaaacctcatcaatcacaaccatgggttcaacaggtgaaactcatataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23137 - DNA, 360 bp, Artificial
  MsCOMT deletion introduced by TALEN pair MsCOMT_T03.1
tctcacaaaaacctcatcaatcacaaccatgggttcaacaggtgaaactcagataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23138 - DNA, 361 bp, Artificial
  MsCOMT deletion introduced by TALEN pair MsCOMT_T03.1
tctcacaaaaacctcatcaatcacaaccatgggttcaacaggtgaaactcagataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23139 - DNA, 360 bp, Artificial
  MsCOMT deletion introduced by TALEN pair MsCOMT_T03.1
tctcacaaaaacctcatcaatcacaaccatgggttcaacaggtgaaactcagataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaataacctcacttgttctgttcgtactcaacaagatggaaaggttcagagactttatggtttggctactgttgctaa

SEQ ID NO: 23140 - DNA, 360 bp, Artificial
  MsCOMT deletion introduced by TALEN pair MsCOMT_T03.1
tctcacaaaaacctcatcaatcacaaccatgggttcaacaggtgaaactcacataacaccaacccccataccagatgcagaagcaaacctcttcgccatgcaattagcaagtgcttcagttcttcccatgattttgaaatcagctcttgaacttgatctcttagaaatcattgctaaagctggacctggtgctcaaatttcacctattggaattgcttctcagctaccaacaactaatgcaccagttatgttggaccgaatgttgcgtcgcttggcttgttacaatatcctcgcttgttcagttcgtactaaacaagatggaaaggttcagagactttatggtttggctgctgtggctaa

SEQ ID NO: 23141 - DNA, 357 bp, Artificial
  MsCOMT deletion introduced by TALEN pair MsCOMT_T03.1
tctcacaaaaacctcatcaatcacaaccatgggttcaacaggtgaaactcacataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23142 - DNA, 367 bp, Artificial
  MsCOMT deletion introduced by TALEN pair MsCOMT_T03.1
tctcacaaaaacctcatcaatcacaaccatgggttcaacaggtgaaactcacataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23143 - DNA, 362 bp, Artificial
  MsCOMT deletion introduced by TALEN pair MsCOMT_T03.1
tctcacaaaaacctcatcaatcacaaccatgggttcaacaggtgaaactcacataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggctagttacaatttcctcacttgttcagttcgtactcaacaaaatggaaagattcagagactttatggtttggctactgttgctaa

SEQ ID NO: 23144 - DNA, 356 bp, Artificial
  MsCOMT deletion introduced by TALEN pair MsCOMT_T03.1
tctcacaaaaacctcatcaatcacaaccatgggttcaacaggtgaaactcaattaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23145 - DNA, 360 bp, Artificial
  MsCOMT deletion introduced by TALEN pair MsCOMT_T03.1
tctcacaaaaacctcatcaatcacaaccatgggttcaacaggtgaaactcaattaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23146 - DNA, 360 bp, Artificial
  MsCOMT deletion introduced by TALEN pair MsCOMT_T03.1
tctcacaaaaacctcatcaatcacaaccatgggttcaacaggtgaaactcaattaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23147 - DNA, 361 bp, Artificial
  MsCOMT deletion introduced by TALEN pair MsCOMT_T03.1
tctcacaaaaacctcatcaatcacaaccatgggttcaacaggtgaaactcaattaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23148 - DNA, 353 bp, Artificial
  MsCOMT deletion introduced by TALEN pair MsCOMT_T03.1
tctcacaaaaacctcatcaatcacaaccatgggttcaacaggtgaaactcaattaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctgctcagctaccaatgcaccagttaggttggacagaatgttgcgtctcttggcttgttacaatatcctcacttgttcagttcgtactcaacaagatggaaaggttcagagactttatggtttggctactgttgctaa

SEQ ID NO: 23149 - DNA, 357 bp, Artificial
  MsCOMT deletion introduced by TALEN pair MsCOMT_T03.1
tctcacaaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23150 - DNA, 357 bp, Artificial
  MsCOMT deletion introduced by TALEN pair MsCOMT_T03.1
tctcacaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 23151 - DNA, 360 bp, Artificial
  MsCOMT deletion introduced by TALEN pair MsCOMT_T03.1
tctcacaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23152 - DNA, 442 bp, Artificial
  MsCOMT deletion introduced by TALEN pair MsCOMT_T03.1
tctcacaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaacgagtggtggaaggtgtacccctccagcgtgaccgagttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23153 - DNA, 360 bp, Artificial
  MsCOMT deletion introduced by TALEN pair MsCOMT_T03.1
tctcacaaaaacctcatcaatcacaaccatgggttcaacaggtgaaactcaagtaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23154 - DNA, 363 bp, Artificial
  MsCOMT deletion introduced by TALEN pair MsCOMT_T03.1
tctcacaaaaacctcatcaatcacaaccatgggttcaacaggtgaaactcaagtaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23155 - DNA, 353 bp, Artificial
  MsCOMT deletion introduced by TALEN pair MsCOMT_T03.1
tctcacaaaaacctcatcaatcacaaccatgggttcaacaggtgaaactcaagtaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23156 - DNA, 260 bp, Artificial
  MsCOMT deletion introduced by TALEN pair MsCOMT_T03.1
tctcacaaaaacctcatcaatcacaaccatgggttcaacaggtgaaactcaagtaacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 23157 - DNA, 358 bp, Artificial
  MsCOMT deletion introduced by TALEN pair MsCOMT_T03.1
tctcacaaaaacctcatcaatcacaaccatgggttcaacaggtgaaactcaactaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatgatttggctactgttgctaa

SEQ ID NO: 23158 - DNA, 353 bp, Artificial
  MsCOMT deletion introduced by TALEN pair MsCOMT_T03.1
tctcacaaaaacctcatcaatcacaaccatgggttcaacaggtgaaactcaactaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgtgacaatatcctcacttgttcagttcgtactcaacaagatggaaagattcagagactttatggtttggctactgttgctaa

SEQ ID NO: 23159 - DNA, 360 bp, Artificial
  MsCOMT deletion introduced by TALEN pair MsCOMT_T03.1
tctcacaaaaacctcatcaatcacaaccatgggttcaacaggtgaaactcaactaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagacattatggtttggctacggttgataa

SEQ ID NO: 23160 - DNA, 360 bp, Artificial
  MsCOMT deletion introduced by TALEN pair MsCOMT_T03.1
tctcacaaaaacctcatcaatcacaaccatgggttcaacaggtgaaactcaaattacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23161 - DNA, 359 bp, Artificial
  MsCOMT deletion introduced by TALEN pair MsCOMT_T03.1
tctcacaaaaacctcatcaatcacaaccatgggttcaacaggtgaaactcaaattacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23162 - DNA, 355 bp, Artificial
  MsCOMT deletion introduced by TALEN pair MsCOMT_T03.1
tctcacaaaaacctcatcaatcacaaccatgggttcaacaggtgaaactcaaatgacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23163 - DNA, 359 bp, Artificial
  MsCOMT deletion introduced by TALEN pair MsCOMT_T03.1
tctcacaaaaacctcatcaatcacaaccatgggttcaacaggtgaaactcaaatgacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggcactgttgctaa

SEQ ID NO: 23164 - DNA, 360 bp, Artificial
  MsCOMT deletion introduced by TALEN pair MsCOMT_T03.1
tctcacaaaaacctcatcaatcacaaccatgggttcaacaggtgaaactcaaatgacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23165 - DNA, 359 bp, Artificial
  MsCOMT deletion introduced by TALEN pair MsCOMT_T03.1
tctcacaaaaacctcatcaatcacaaccatgggttcaacaggtgaaactcaaatgacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23166 - DNA, 359 bp, Artificial
  MsCOMT deletion introduced by TALEN pair MsCOMT_T03.1
tctcacaaaaacctcatcaatcacaaccatgggttcaacaggtgaaactcaaatgacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23167 - DNA, 360 bp, Artificial
  MsCOMT deletion introduced by TALEN pair MsCOMT_T03.1
tctcacaaaaacctcatcaatcacaaccatgggttcaacaggtgaaactcaaatgacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23168 - DNA, 359 bp, Artificial
  MsCOMT deletion introduced by TALEN pair MsCOMT_T03.1
tctcacaaaaacctcatcaatcacaaccatgggttcaacaggtgaaactcaaatgacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 23169 - DNA, 356 bp, Artificial
  MsCOMT deletion introduced by TALEN pair MsCOMT_T03.1
tctcacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23170 - DNA, 360 bp, Artificial
  MsCOMT deletion introduced by TALEN pair MsCOMT_T03.1
tctcacaaaaacctcatcaatcacaaccatgggttcaacaggtgaaactcaaatatcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23171 - DNA, 360 bp, Artificial
  MsCOMT deletion introduced by TALEN pair MsCOMT_T03.1
tctcacaaaaacctcatcaatcacaaccatgggttcaacaggtgaaactcaaatagcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23172 - DNA, 362 bp, Artificial
  MsCOMT deletion introduced by TALEN pair MsCOMT_T03.1
tctcacaaaaacctcatcaatcacaaccatgggttcaacaggtgaaactcaaatagcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23173 - DNA, 360 bp, Artificial
  MsCOMT deletion introduced by TALEN pair MsCOMT_T03.1
tctcacaaaaacctcatcaatcacaaccatgggttcaacaggtgaaactcaaatacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23174 - DNA, 360 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23175 - DNA, 248 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 23176 - DNA, 360 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23177 - DNA, 363 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23178 - DNA, 349 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23179 - DNA, 355 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23180 - DNA, 356 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 23181 - DNA, 349 bp, Artificial
  MsCOMT deletion introduced by TALEN pair MsCOMT_T03.1
tctcacaaaaacctcatcaatcacaaccatgggttcaacaggtgaaactcaaataataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaagattcagagactttatggtttggctactgttgctaa

SEQ ID NO: 23182 - DNA, 341 bp, Artificial
  MsCOMT deletion introduced by TALEN pair MsCOMT_T03.1
tctcacaaaaacctcatcaatcacaaccatgggttcaacaggtgaaactcaaataactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcgtctcttggcttgttacaatatcctccctttttcatttcttactcaacaagatggaaagattcagagactttatggtttggctacttttgctaa

SEQ ID NO: 23183 - DNA, 359 bp, Artificial
  MsCOMT deletion introduced by TALEN pair MsCOMT_T03.1
tctcacaaaaacctcatcaatcacaaccatgggttcaacaggtgaaactcaaataactccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtcgcttggcttgttacaatatcctcacttgttcagttcgtactcaacaagatggaaaagtacagagactttatggtttggctactgttgctaa

SEQ ID NO: 23184 - DNA, 355 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23185 - DNA, 355 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23186 - DNA, 349 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaagattcagagactttatggtttggctactgttgctaa

SEQ ID NO: 23187 - DNA, 362 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23188 - DNA, 358 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23189 - DNA, 270 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 23190 - DNA, 350 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23191 - DNA, 409 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagccacgatggcggcaagcaggcgctggagacggtccagcggctgttctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23192 - DNA, 352 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 23193 - DNA, 360 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23194 - DNA, 357 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23195 - DNA, 341 bp, Artificial
  MsCOMT deletion introduced by TALEN pair MsCOMT_T03.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 23196 - DNA, 360 bp, Artificial
  MsCOMT deletion introduced by TALEN pair MsCOMT_T03.1
tctcacaaaaacctcatcaatcacaaccatgggttcaacaggtgaaactcaaataaccccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtcgcttggcttgttacaatatcctcacttgttcagttcgtactcaacaagatggaaagagtcagagactttagggtttggctactgttgctaa

SEQ ID NO: 23197 - DNA, 349 bp, Artificial
  MsCOMT deletion introduced by TALEN pair MsCOMT_T03.1
tctcacaaaaacctcatcaatcacaaccatgggttcaacaggtgaaactcaaataacatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaagttcagagactttatggtttggctactgttgctaa

SEQ ID NO: 23198 - DNA, 360 bp, Artificial
  MsCOMT deletion introduced by TALEN pair MsCOMT_T03.1
tctcacaaaaacctcatcaatcacaaccatgggttcaacaggtgaaactcaaataacatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23199 - DNA, 362 bp, Artificial
  MsCOMT deletion introduced by TALEN pair MsCOMT_T03.1
tctcacaaaaacctcatcaatcacaaccatgggttcaacaggtgaaactcaaataacatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23200 - DNA, 362 bp, Artificial
  MsCOMT deletion introduced by TALEN pair MsCOMT_T03.1
tctcacaaaaacctcatcaatcacaaccatgggttcaacaggtgaaactcaaataacatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23201 - DNA, 345 bp, Artificial
  MsCOMT deletion introduced by TALEN pair MsCOMT_T03.1
tctcacaaaaacctcatcaatcacaaccatgggttcaacaggtgaaactcaaataacatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaagattcagagactttatggtttggctactgttgctaa

SEQ ID NO: 23202 - DNA, 361 bp, Artificial
  MsCOMT deletion introduced by TALEN pair MsCOMT_T03.1
tctcacaaaaacctcatcaatcacaaccatgggttcaacaggtgaaactcaaataacagcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23203 - DNA, 357 bp, Artificial
  MsCOMT deletion introduced by TALEN pair MsCOMT_T03.1
tctcacaaaaacctcatcaatcacaaccatgggttcaacaggtgaaactcaaataacactaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23204 - DNA, 355 bp, Artificial
  MsCOMT deletion introduced by TALEN pair MsCOMT_T03.1
tctcacaaaaacctcatcaatcacaaccatgggttcaacaggtgaaactcaaataacactaacccacatatcagatgaagaagcaaacctcttcgccatgcaactagcaagtgcttcagttcttcccatgattttaaaatcagctcttgaacttgatctcttagaagtcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23205 - DNA, 361 bp, Artificial
  MsCOMT deletion introduced by TALEN pair MsCOMT_T03.1
tctcacaaaaacctcatcaatcacaaccatgggttcaacaggtgaaactcaaataacacctacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23206 - DNA, 362 bp, Artificial
  MsCOMT deletion introduced by TALEN pair MsCOMT_T03.1
tctcacaaaaacctcatcaatcacaaccatgggttcaacaggtgaaactcaaataacacctacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23207 - DNA, 359 bp, Artificial
  MsCOMT deletion introduced by TALEN pair MsCOMT_T03.1
tctcacaaaaacctcatcaatcacaaccatgggttcaacaggtgaaactcaaataacacctacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactctacaagatggaaaggttcagagactttatcgtttgtctactgttgctaa

SEQ ID NO: 23208 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23209 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23210 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23211 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23212 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23213 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23214 - DNA, 353 bp, Artificial
  MsCOMT deletion introduced by TALEN pair MsCOMT_T03.1
tctcacaaaaacctcatcaatcacaaccatgggttcaacaggtgaaactcaaataacacccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23215 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23216 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaagattcagagactttatggtttggctactgttgctaa

SEQ ID NO: 23217 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23218 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23219 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccatcccacatatcagatgaagaagcaaacctcttcgccatgcaactagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 23220 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccagcccacatatctgatgaagaagcaaacctcttcgccatgcaattagcaagtgcttcagttcttcccatgattttaaaatcagctcttgaacttgatctcttagaaatcatagctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 23221 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccagcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23222 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccagcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23223 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaccccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23224 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaaagttcagagactttatggtttggctactgttgctaa

SEQ ID NO: 23225 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23226 - DNA, 309 bp, Artificial
  MsCOMT deletion introduced by TALEN pair MsCOMT_T03.1
tctcacaaaaacctcatcaatcacaaccatgggttcaacaggtgaaactcaaataacaccacccacatatcagatgaagaagcaaacctcttcgccatgcaattagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttctgttcgtactcaacaagatggaaaggttcagagactttatggtttggctactgttgctaa

SEQ ID NO: 23227 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23228 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23229 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaatccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 23230 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaatccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23231 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaatccacatatcagatgaagaagcaaacctcttcgccatgcaactagcaagtgcttcagttcttcccataattttaaaatcagctcttgaacttgatctcttagaaatcattgctaaagctggacctggtgctcaaattactcctattgcaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23232 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaagccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23233 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaagccacatatcagatgaagaagcaaacctcttcgccatgcaattagcaagggcttcagttcttcccatgattttaaaatcagctcttgaacttgatctcttagaaatcattgctaaagctggacctggtgctcatatgtgacctattgaaatagcttctcagctaccaacaactaagcaccagttatgttggaccgaatgttacctccctgggcttgttacaagaacctctcttgttcagtgcgtactcaacaagatggaaaggttcagagactttatggtttggcaactgttgcgat

SEQ ID NO: 23234 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaagccacatatcagatgaagaagcaaacctcttcgccatgcaactagcaattgcttcagttcttccaatgattttgaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttctgttcgtactcaacaagatggaaaggttcagagactttatggtttggctactgttgctaa

SEQ ID NO: 23235 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaagccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23236 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaagccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23237 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23238 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23239 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23240 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23241 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 23242 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 23243 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacctacatatcagatgaagaagcaaacctcttcgccatgcaactagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaggttcagagactttatggtttggctactgttgctaa

SEQ ID NO: 23244 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacctacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23245 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacctacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23246 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaaccgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaggtggtggccatcgccagcaatggcggtggcaagcaggcgctggagacggtctctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 23247 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaaccgacatatcagatgaagaagcaaacctcttcgccatgcaattagcaagggcttcagttcttcccatgattttgaaatcagctcttgaacttgatctcttagaaatcattcataaagctggacctgatgttcaacttttacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23248 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaaccgacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23249 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaaccctcatatcagatgaagaagcaaacctcttcgccatgcaattagcaagtgcttcagttcttcctatgcttttaaaatcagctcttgaacttgatctcttagaaatcattgctaaagctggacctggtgctcaaatttcacctgttcaaattgcttctcagcttccaacaactgatgcaccagtcatgttggaccgaatgttgcgtcgcttggcttgttacaatatcctcacttgttctgttcgtactcaacaaaatggaaaggttcagagactgtatggtttggctactgttgctaa

SEQ ID NO: 23250 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaaccctcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23251 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaaccctcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23252 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaaccctcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23253 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaaccctcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23254 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaaccctcatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23255 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccgcatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23256 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccgcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23257 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccgcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23258 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccccatatcagatgcagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgtggctaa

SEQ ID NO: 23259 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccccatatcagatgaagaagcaaacctcttcgccatgcaattagcaagtgcttcagttcttcccatgattttaaaatcagctcttgaacttgatctcttagaaatcattgctaaagctggacctgatgctcaaatttcatctattgaaattgcttctcagctcccaacaacttgccggtgctgtgccaggcccacggcttgacccctgagcaggtggctgatgcaccagttttgttggaacgaatgttgcgtctattggcttgtttcaatatcctcacttgttcagttcgtactcaacaagatggaaagattcagagactttatgggttggctactgttgctaa

SEQ ID NO: 23260 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcagttagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23261 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23262 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23263 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23264 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23265 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23266 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23267 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttaaaatcagctcttgaacttgatctcttagaaatcattgctaaagctgtacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23268 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccagtcatgttggaccgaatgttgcgtctcttggcttgttacaatatcctcacttgttctgttcgtactcaacaagatggaaaggttcagagactttatggtttggctactgttgctaa

SEQ ID NO: 23269 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccagatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23270 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacttatcagatgaagaagcaaacctcttcgccatgcaattagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23271 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacttatcagatgaagaagcaaacctcttcgccatgcaattagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23272 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23273 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacttatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttctgttcgtactcaacaagatggaaaggttcagagactttatggtttggctactgttgctaa

SEQ ID NO: 23274 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacgtatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23275 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacgtatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23276 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatttcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccagtgcaccagttatgttggaccgaatgttgcgtctcttggcttgttacaatatcctcacttgttcagttcgtactcaacaagatggaaaggttcagagactttatggtttggctactgttgctaa

SEQ ID NO: 23277 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatttcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggttcggctactgttgctaa

SEQ ID NO: 23278 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatttcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23279 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatttcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 23280 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatgtcagatgaagaagcaaaccttttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23281 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatgtcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23282 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatgtcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23283 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatattagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23284 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatattagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23285 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatattagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23286 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatattagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23287 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatgagatgaagaagcaaacctcttcgccatgcaactagcaagtgcttcagttcttcccatgattttgaaatcagctcttgaacttgatcttttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23288 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatgagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagatactttatggtttggctactgttgctaa

SEQ ID NO: 23289 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatctgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23290 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatctgatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaggatggaaaggttcagagacttgatggtttggctactgttgctaa

SEQ ID NO: 23291 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatctgatgaagaagcaaacctcttcgccatgcaactagcaagtgcttcagttcttcccatgattttaaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23292 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 23293 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaagttcagagactttatggtttggctactgttgctaac

SEQ ID NO: 23294 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 23295 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23296 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacagcaccggcaacaggcgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23297 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23298 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 23299 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaaggttcagagactttatggtttggctactgttgctaac

SEQ ID NO: 23300 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23301 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23302 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 23303 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23304 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23305 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23306 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatccgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23307 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatccgatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23308 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23309 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23310 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23311 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23312 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcatatgaagaagcaaacctcttcgccatgcaactagcaagtgcttcagttcttcccatgattttaaaatcagctcttgaacttgatctcttagaaatcattgctaaagatggacctggtgatcaaatttcacctattgaaattgcttatcagctaccaacactatgcaccagttatgttggaccgaatgttgcgtcacttggcttgttacaatatcctcacttgttcagttcgtactaaacaagatggaaaggttcagagactttatggtttggctactgtagataa

SEQ ID NO: 23313 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagttgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttattacaatatcctcacttgttcagttcgtactcaacaagatggaaaggttcagagactttatggtttggctactgttgctaa

SEQ ID NO: 23314 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaggtgaggaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23315 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaggtgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23316 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaggtgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctattggcttgttacaatatcctcacttgttctgttcgtactcaacaagatggaaaggttcagagactttatggtttggctactgttgctaa

SEQ ID NO: 23317 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23318 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagctgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23319 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagctgaagaagcaaacatcttcgccatgcaactagcaagtgcttcagttcatcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23320 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagattcagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagattgaaaggttcagagactttagggtttggctactgtggctaa

SEQ ID NO: 23321 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 23322 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23323 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23324 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23325 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagattaagaagcaaacctcttcgccatgcaactagcaagtgcttcagttcttcccatgattttgaaatcagctcttgaacttgatctcttagaaatcattgctaaagctggacctgttgctcaaatttcacctattgaaattgcttctcagctaccaacaacctgatgcaccagttatgttggaccgaatgttgcgtctcttggcttgttacaatatcctcccttgttcagttcgtactcaacaagatggaaaggttcagagactttatggtctggttactgttgctaa

SEQ ID NO: 23326 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgtagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23327 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23328 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23329 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaattagcaagtgcttcagttcttcccatgattttaaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23330 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23331 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23332 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23333 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 23334 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23335 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgcagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctaccaacaagatgcaccagttatgttggaccgaatgttgcgtcacttggcttgttacaatatcctcacttgtgcagttcgtactcgacaagatggaaaggttcagagactttatggtttggctatgttgctaa

SEQ ID NO: 23336 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgatgaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23337 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgatgaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacggatggcctttttgcgtttctacaaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23338 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgatgaagcaaacctcttcgccatgcaactagcaagtgcttcagttcttcccatgattttgaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaaggttcagagactttatggtttggctactgttgctaa

SEQ ID NO: 23339 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaggaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23340 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23341 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23342 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23343 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23344 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23345 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgacgaagcaaacctcttcgccatgcaattagcaagtgcttcagttcttcccatgattttaaaatcagctcttgaacttgatctcttagaaatcattgctcaagctggacctggtgctcaaatttcacctattgaaattgcttctcagctcccaacaactactgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 23346 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaataagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 23347 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23348 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaataagcaaacctcttcgccatgcaactagcaagtgcttcagttcttcccatgattttgaaatcagctcttgaactttatctcttggcttgttacaatatcctcacttgttcagttcgtactcaacaagatggaaaggttcaaagactttatggtttggctactgttgctaa

SEQ ID NO: 23349 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 23350 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaaggagcaaacctcttcgccatgcaattagcaagtgcttcagttcttcccatgattttaaaatcagctcttgacttgttacaatatcctcacttgttcagttcgtactcaacaagatggaaaggttcagagactttatggtttggctactgttgctaa

SEQ ID NO: 23351 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaaggagcaaacctcttcgccatgcaactagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaggttcagagactttatggtttggctactgttgctaa

SEQ ID NO: 23352 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaaggagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23353 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaaggagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23354 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagcagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 23355 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagcagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaagattcagagactttatggtttggctactgttgctaa

SEQ ID NO: 23356 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaggcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23357 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaggcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23358 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaggcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23359 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaggcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23360 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaggcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23361 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaggcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactcattgccaaatgtttgaacgatcgcgccctcctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 23362 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23363 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaccctgatgcatcagttatgttggaccgaatgttgcgtcacttggcttgttacaatttccacacttgttcagttcgtactcagcaagatggaaaggttcagagactttatggtttggctactctacctaa

SEQ ID NO: 23364 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23365 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23366 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttagaatatcctcacttgttcagttcgtactcaacaagatggaaagattcagagactttatggtttggctactgttgctaa

SEQ ID NO: 23367 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 23368 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgctctcttagaaatcattgctaaagctggacctagtgctcaaatttcgtctattgacattgctactcagctaccaacgactgatgcaccagttatgtcagaccgaattttgcaaatagtggattgagacaacgtcctcacttctgcagttcttactcaactagaaggaaatattcagagactttatggtttggcgactgttactaa

SEQ ID NO: 23369 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaagtacagagactttatgatttggcgactgttgctaa

SEQ ID NO: 23370 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatggtgcgtctcttggcttgttacaatatcctcacttgttcagttcgtacgcaacaagatgtaaaggttcagagactttatggtttggctactgatgctaa

SEQ ID NO: 23371 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaatcaaacctcttcgccatgcaactagcaagggcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23372 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23373 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23374 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23375 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23376 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttaaaatcagctcttgaacttgatctacaagatggaaagattcagagactttatggtttggctactgttgctaa

SEQ ID NO: 23377 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagtaaacctcttcgccatgaaactagcaagtgcttcagttcttcccatgattttgaaatcagctcttgaacttgatctcttagaaatcattgctaaagctggacctggtgctcaaatttcaactattgaaattgcttctcagctaccaacaactaacccccctgatgcaccagggaggggggaccgaatgttgcggcgcggggcgggggacaagatcctcacgggggcagggcggactcaacaagatggaaaagggcagagacttgagggcgtggctactgttgctaa

SEQ ID NO: 23378 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagctaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23379 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcgaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23380 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcgaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23381 - DNA, 309 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcgaacctcttcgccatgcaactagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttcagttcgtactcaacaagatggaaaggttcagagactttatggtttggctacgttgctaa

SEQ ID NO: 23382 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcgaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccgatgcaccagttatgttggaccgaatgttatgtctcttggcttgttacaatatcctcacttgttcagttcgtactcaacaagatggaaagattcagagactttatggtttggctactgttgctaa

SEQ ID NO: 23383 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcgaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23384 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcgaacctcttcgccatgcaactagcaagtgcttcagttcttcccatgattttgaaatcagctcttgaacttgatctacaagatggaaagattcagagactttatggtttggctactgttgctaa

SEQ ID NO: 23385 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcgaacctctacgccatgcaactagcaagtgcttcagttcttcccatgaatttgagatcagctcttgaacttgatctcttagaaatcattgctaaagctggaccaggtgatcaaatttcccctattgaaattgcttctcagctaccaacaactgatgcaccagttatgttggaccgaatgttgcgtctcttggcttgttacaatttcctcacttgttcagttcgtactcaacaagatgtaaaggttcagagactttatggtttggctactgttgctaa

SEQ ID NO: 23386 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagccaacctcttcgccatgcaactagcaaatgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23387 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcatacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaaggttcagagactttatggtttggctactgttgctaa

SEQ ID NO: 23388 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcagacctcttcgccatgcaattagcaagtgcttcagttcttcccatgattttgaagtcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcttcacttgtttagttcgtactcaacaagatggaaaggttcagagactttatggtttggctactgttgctaa

SEQ ID NO: 23389 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcagacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23390 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcagacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23391 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcagacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23392 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcagacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23393 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcacacctcttcgccatgcaattagcaagtgcttcagttcttcccatgattttaaaatcagctcttgaacttgatctcttagaaatcattgctacagctggaccaggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23394 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaagattcagagactttatggtttggctactgttgctaa

SEQ ID NO: 23395 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcacacctcttcgccatgcaattagcaagtgcttcagttcctcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23396 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaatcctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23397 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaatcctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 23398 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaagcctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23399 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaagcctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatttgtcctactcaggagagcgttcaccgacaaacaacagataaaacgaaaggcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23400 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23401 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23402 - DNA, 298 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaacctcttcgccatgcaactagcaagggcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 23403 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 23404 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaagattcagagacgttatggtttggctactgttgctaa

SEQ ID NO: 23405 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaccctcttcgccatgcaactagcaagtgcttcagttcttcccatgattttaaaatcagctcttgaacttgatctcttcgaaatcattgctaaagctggacctggtgctcaaatttcacctattgaaattgcttctcagctaccaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23406 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaatctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttctgttcgtactcaacaagatggaaaggttcagagactttatggtttggctactgttgctaa

SEQ ID NO: 23407 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaatctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23408 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaatctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23409 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaatctcttcgccatgcaactagcaagtgcttcagttcttcccatgattttgaaatcagctcttgaacttgatctcttagaaatcattgctaaagctggacctggtgcgcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23410 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaagctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23411 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacttcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactttgctaa

SEQ ID NO: 23412 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacttcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23413 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacttcttcgccatgcaactagcaagtgcttcagttcttcccatgattttgaaatcagctcttgaacttgatctcttagaaatcattgctaaagctggacctggtgctcaaatttcacctattgaaattgcgtctcagctcccaacatgatgcaccaattatgttggaccgaatgttgcgtctcttggcttgttacaatatcctcacttgttcagttcgtactcaacaagatggaaaggttcagagactttatggtttggctactgttgttaa

SEQ ID NO: 23414 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccttttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23415 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccttttcgccatgcaattagcaagtgcttcagttcttcccatgattttaaaatcagctcttgaacttgatctacaagatggaaagattcagagactttatggtttggctactgttgctaa

SEQ ID NO: 23416 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccttttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23417 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctgttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23418 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctgttcgccatgcaactagcaagtgcttcagttcttcccatgattttgaaatcagctcttgaacttgatctcttagaaaacattgctaaagctggacctggtgctcaaatttcacctattgaaattgcttctcagctaccaacaaccttgatgcacccgttatgttggaccgaatgttgcgtcacttggcatgttccaatatcctcacttgttcagttcgtactcaacaagatagaaaggttcagagactttatggtttggctactgttgctaa

SEQ ID NO: 23419 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctgttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23420 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctgtacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23421 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23422 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23423 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttctgttcgtactcaacaagatggaaagattcagagactttatggtttggctactgttgctaa

SEQ ID NO: 23424 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23425 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23426 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23427 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaagattcagagactttatggtttggctactgttgctaa

SEQ ID NO: 23428 - DNA, 448 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgccggtgctgtgccaggcccacggcttgaccccggagcaggtggtggccatcgccagcaatattggtggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23429 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23430 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23431 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23432 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaactagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23433 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctttgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23434 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttggccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23435 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttggacatgcaactagcaagtgcttcagttcttcccatgattttgaaatcagctcttgaacttgatctcttagaagtcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23436 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 23437 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttaaaatcagctcttgaacttgctctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23438 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 23439 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaactatcaagtgcttcagttcttcccatgattttaaaatcagctcttgaacttgatctcttagaaatcattgctaaagctggacctggtgctcaaatttcacctatggaaattgattctcagctcccaacaaatgcaccagttatgttggaccgaatgttgcgtctcttggcttgttacaatatcctcacttgttcagttcgtactcaacaagatggaaagattcagagactgtatggtttggctactgttgctaa

SEQ ID NO: 23440 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 23441 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 23442 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgcaccagttatgttggaccgaatgttgcgtctcttggcttgttacaatatcctcacttgttcagttcgtactcaacaagacggaaaggttcagagactttatggtttggctactgttgctaa

SEQ ID NO: 23443 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 23444 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaaggttcagagactttatggtttggctactgttgctaa

SEQ ID NO: 23445 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctaagctcccaacaatatgtttcgtctcttggcttgttgcaatatcctcacttgttaagttcgtaatcaacaagatagaaagattcagagactttatggtttggatactgttgctaa

SEQ ID NO: 23446 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttgtaccgaattttgcgtctcttggcttgttacaatatcctcacttgttcagttcgtactcaacaagatggaaagattcagagactttatggtttggctactgttgctaa

SEQ ID NO: 23447 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23448 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgacattgcttctcagctcccaacaccttatcttcgagccagccacgatcgacattgatctgtgatgcaccagttatgttggaccgaatgttgcggctcttggcttgttacaatatcctcacttgttcagttcgtactcaacaagatggaaagattcagagactttatggtttggctactgttgctaa

SEQ ID NO: 23449 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccatgatgcaccagttatgttggaccgaatgttgcgtctcttggcttgttacaatatcctcactggttcagttcgtactcaacaagatggaaaggttcagagactttatggtttggctactgttgctaa

SEQ ID NO: 23450 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23451 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23452 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23453 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23454 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23455 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaagattcagagactttatggtttggctactgttgctaa

SEQ ID NO: 23456 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23457 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23458 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23459 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 23460 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattgctaaagctggacctagtgctcaaatttcacctgttcaaattgcttctcagcttccaacaactaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23461 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaattaacaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggctactgttgctaa

SEQ ID NO: 23462 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttggcttgttacaatatcctcacttgttcagttcgtactcaacaagatggaaaggttcagagactttatggtttggctactgttgctaa

SEQ ID NO: 23463 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctgttgctcaaatttcacctgttcaaattgcttctcatcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23464 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcactcatgcaccaattatttttctcctcatattgcttctcttggcttgttacaatatcctcacttgttcagttcgtactcaacaagattgaaaggttcagagactttatggtttggctactgttgctaa

SEQ ID NO: 23465 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23466 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23467 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23468 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23469 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23470 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23471 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23472 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23473 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23474 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23475 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23476 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23477 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23478 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23479 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcttctcttggcttgttacaatatcctcacttgttcagttcgtactcaacaagatggaaaggttcagagactttatggtttggctactgttgctaa

SEQ ID NO: 23480 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttatcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23481 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23482 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 23483 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23484 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23485 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgctaa

SEQ ID NO: 23486 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcggcatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtgctcaacaagatagaaatgttcagagacttgatggtttgggtactgttgctaa

SEQ ID NO: 23487 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcggcatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23488 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgctatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23489 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgctatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 23490 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgctatgcaattagcaagtgcttcagtccttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23491 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgctatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23492 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcgatgcaattagcaagtgcttcagttcttcccatgattttaaaatcagctcttgaacttgatctcttagaaatcattgctaaagctggacctggtgctcaaatttcacctgttcaaattgcttctcagctaccaacactgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 23493 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcgatgcaactagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23494 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccttgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23495 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccttgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23496 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23497 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23498 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23499 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccgtgcaattagcaagtgcttcagttcttcccatgattttgaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23500 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccgtgcaattagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23501 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccgtgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23502 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccgtgcaactagcaagtgcttcagttcttcccatgattttgaaatcagctcttgaacttgatctcttagaaatcattgctaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctacagttgctaa

SEQ ID NO: 23503 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccgtgcaactagcaagtgcttcagttcttcccatgattttgaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacggcaccggcaacagccgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23504 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccgtgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23505 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcagcaagatggaaagattcagagactttatggtttggctactgttgctaa

SEQ ID NO: 23506 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23507 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactttgtgcacgacgacatcattccgtcgcgttatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23508 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccctgcaactagcaagtgcttcagttcttcccatcattttgaaatcagctcttgaacttgatctcttagaaatcattgctaaagctggacctggtgctcaaatttcacctattgaaattgcttctcagctcccaacaagatgcaccagttatgttggaccgaatgttgcgtcgattggcttgttacaatatcctcacttgttcagttcgtacgcaacaagatggaaaggttcagagactttatggtttggctactgttgctaa

SEQ ID NO: 23509 - DNA, 454 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccattcaattagctagtgcttcagttcttcccatgattttaaaatcagctcttgaacttgatctcttagaaatcattgctaaagctggacctggtgctcaaatttcacctattgaaattgcttctcagctcccaacaactaaccgccatcgtggcgggcgcggcccaccacctgccccggggtcaagccgtgggcctggcccagcaccggcaacagccgctggaccgtctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23510 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggatcgaatgttgcgtctcttggcttgttacaatatcctcacttgttctgttcgtactcaacaagatggaaaggttcagagactttatggtttggctactgttgctaa

SEQ ID NO: 23511 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 23512 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23513 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23514 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23515 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23516 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 23517 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23518 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23519 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23520 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23521 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23522 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23523 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23524 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23525 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23526 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23527 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 23528 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23529 - DNA, 430 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactacccacggcttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23530 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23531 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 23532 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23533 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttaaaatcagctcttgaacttgatctacaagatggaaagattcagagactttatggtttggctactgttgctaa

SEQ ID NO: 23534 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatggaattagcaagtgcttcagttcttcccatgattttgaaatcagctcttgaacttgatctcttagaaatcattgctaaagctggacctggtgctcaaatttctcctattgaaattgcttctcagctaccaacaactgatgcacccgttatgttggaccgaatgttgcgtctcttggcttgttacactatcctcacttgttcatttcgtactcaacaagatggaaaggttcagagcctttatggtttggctactgttgctaa

SEQ ID NO: 23535 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatggaattagcaagtgcttcagttcttcccatgattttaaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23536 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgctactagcaagtgcttcagttcttcccatgattttgaaatcagctcttgaacttgatctcttagaaatcattgctaaagctgtacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23537 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23538 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 23539 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcgactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23540 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcgactagcaagtgcttcagttcttcccatgattttgaaatcagctcttgaacttgatctcttagaaatcattgctaaagctggacctggtgctcaaatttcacctattgaaattgcttctcagctcccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 23541 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgccactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23542 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcatttagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23543 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcatttagcaagtgcttcagttcttcccatgattttgaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23544 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcatttagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaagattcagagactttatggtttggctactgttgctaa

SEQ ID NO: 23545 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcatctagcaagtgcttcagttcttcccatgattttgaaatcagctcttgaacttgatctcttagaaatcattgctaaagctggacctggtgctcaaatttcacctattgaaattgcttctcagcttccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23546 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcatctagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgtttctaa

SEQ ID NO: 23547 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagttagcaagtgcttcagttcttcccatgattttaaaatgagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 23548 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagttagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23549 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagttagcaagtgcttcagttcttcccatgattttaaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23550 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacatgatggaaagattcagagactttatggtttggctactgttgctaa

SEQ ID NO: 23551 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23552 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23553 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggctcagtatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23554 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23555 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23556 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23557 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcacttagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 23558 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcacaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23559 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaatttgcaagtgcttcagttcttcccatgattttaaaatcagctcttgaacttgatctacaagatggaaagattcagagactttatggtttggctactgttgctaa

SEQ ID NO: 23560 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattggcaagtgcttcagttcttcccatgattttaaaatcagctcttgaacttgatctacaagatggaaagattcagagactttatggtttggctactgttgctaa

SEQ ID NO: 23561 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattgcaagtgcttcagttcttcccatgattttaaaatcagctcttgaacttgatctcttagaaatcattgctaaagctggacctggtgctcaaatttcacctgttcaaattgcttctcagcttccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23562 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattatcaagtgcttctgttcttcgcatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23563 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23564 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23565 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23566 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23567 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttgaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 23568 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23569 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttgaaatcagctcttgaacttgatctcttagaaatcattgctaaagctggacctggtgctcaaatttcacctatcgaaattgcttctcagctcccaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23570 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctggaccgaatgttgcgtctcttggcttgttacaatatcctcacttgttcagttcgtactcaacaagatggaaaagttcagagactttatggtttggctactgttgctaa

SEQ ID NO: 23571 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23572 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaatgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23573 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23574 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23575 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaacaactgatgcaccaggtatgttggaccgaatgttgcgtctcttggcttgttacaatatgctcacttgttcagttcgtactcaacaagatggaaaggttcagagactttatggtttggctactgttgctaa

SEQ ID NO: 23576 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23577 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23578 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaggttcagagactttatggtttggctactgttgctaa

SEQ ID NO: 23579 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23580 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23581 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23582 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcgagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaaggttcagagactttatggtttggctactgttgctaa

SEQ ID NO: 23583 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcgagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaagttcagagactttatggtttggctactgttgctaa

SEQ ID NO: 23584 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcatgtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23585 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcatgtgcttcagttcttcccatgattttaaaatcagctcttgaacttgatctcttagaaatcattgctaaagctagacctggtgctcaaatttcacctattgaaattgcttctcagctcccaacagactgggcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23586 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcagtgcttcagttcttcccatgattttaaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaaggttcagagactttatggtttggctactgttgctaa

SEQ ID NO: 23587 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23588 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaggtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23589 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaggtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctctgggcttgttacaatatcctcacttgttcagttcgtactcaacaagatggaaagattcagagactttatggtttggctactgttgctaa

SEQ ID NO: 23590 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcacgtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23591 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcacgtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23592 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23593 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaattgcttcagttcttcacatgattttaaaatcatctcttgaacttgatctcttagaaatcattgctaaagctggacctggtgctcaaatttcacctattgaaattgcgtctcagctcccaacaactaatgcaccagttatgttggaccgaatgtttcgtctcttggcttgttacaatatcctcactttttcacttcgtactcaacaagatggaaatattcagagactttatggtttggctactgttgctaa

SEQ ID NO: 23594 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 23595 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23596 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacatattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23597 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgtttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23598 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttgagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23599 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttctgttcttcccatgattttgaaatcagctcttgaacttgatctcttagaaatcattgctaaagctggacctggtgctcaaatttcacctattgaaattgcttctcagctaccaacaactaacaccattattgctggcgatggccaccacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23600 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttgacatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23601 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 23602 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23603 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23604 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23605 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23606 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatatcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctacgttctaa

SEQ ID NO: 23607 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttccgttcttcccatgattttaaaatcagctcttgaacttgatctcttagaaataattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23608 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcatttcttcccatgattttaaaatcagctcttgaacttgatctcttagaaatcattgctaaagctggacctgttgctcaaatttctcctattgaaattgcttctcagctcccaacattcaccagttatgttggaccgaatgttgcgtctcttggcttgttacaatatcctcacttgttcagttcgtactcaacaagatggaaatgttcagagacgttatggtttggctactggtgctaa

SEQ ID NO: 23609 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctgttcaaattgcttctcttggcttgttacaatatcctcacttgttcagttcgtactcaacaagatggaaagattcagagactttatggtttggctactgttgctaa

SEQ ID NO: 23610 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23611 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttgttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23612 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttgttcccatgattttaaaatcagctcttgaacttgatctcttagaaatcattgctaaagctggacctggtgctcaaatttcacctattgaaattgcttctcagctaccaatgcaccagttatgttggaccgaatgtggcgtctcttggcttgttacaatatcctcacttgttcagttcgtactcaacaagatggaaaagttcagagactttatggtttggctactgttgctaa

SEQ ID NO: 23613 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctttccatgattttgaaatcagctcttgaacttgatctcttagaaatcattgccaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23614 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctttccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23615 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctttccatgattttaaaatcagctcttgaacttgatctcttagaaatcattgctaaagccggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 23616 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttgccatgattttaaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 23617 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcgcatgattttaaaatcagctcttgaacttgatctcttagaaatcattgctaaagctggacctggtgctcaaatttcacctgttcaaactgcttcgcagcttccaacaacctgatgcaccagtcatgttggaccgaatgttgcatctcttgacttgttacaatatccttacttattctgttcgtactcaacaagatggaaaagttcacagactttattgtcaggctacctttgctaa

SEQ ID NO: 23618 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcgcatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23619 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatgagctcttgaacttgatttcttagaaatcattgctaaaactggacctagtgctcaaatttcacctattgaaattgcttctcagataccaaaatacaccagttatgtttgaccgaatattgcgtctcttgtcttattacaatatcctcacttattcaattcatactcaacaacatttaaatattcacatactttattgtttccctactgttgctaa

SEQ ID NO: 23620 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagatatcattgctaaagctggacctggtgctcaaatttcacctattgaaattgcttctcagcgatgcaccagttatgttggaccgaatgttgcgtctcttggcttgttacaatatcctcacttgttcaggtcgtactcaacaagatggaaaggttcagagactttatggtttggctactgttgctaa

SEQ ID NO: 23621 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaaatcattgctaaagctggatctggtgctcaactttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctacttttgctaa

SEQ ID NO: 23622 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 23623 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaaatcattgctaaagctggacctggtgctcaaatttcacctattgaaattgcttctcagctcgatgcaccagttatgttggaccgaattttgcgtctcttggcttgttacaatatcctcacttgttcagttcgtactcaacaagatggaaagattcagagactttatggtttggctactggtgctaa

SEQ ID NO: 23624 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23625 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23626 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccgatgattttgaaatcagctcttgaacttgatctcttagaaatcattgctaaagcttgacctggtgctcaaatttcacctattgaaagtgcttctcaggtaccaacaacctgctgcaccagttatgttggaccgaatgttgcgtcgcttggcttgttacaatatcctcagttgttcagttcgtactcaacaggattgaaaggttcggagactttatggtttggctactgtggctaa

SEQ ID NO: 23627 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccgatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23628 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccgtgattttaaaatcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttctgttcgtactcaacaagatggaaaggttcagagactttatggtttggctacgttgctaa

SEQ ID NO: 23629 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccgtgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23630 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccattattttaaaatcagctcttgaacttgatctcttagaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23631 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccattattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23632 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccattattttaaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaagattcagagactttatggtttgctactgttgctaa

SEQ ID NO: 23633 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccattattttaaaatcagctcttgaacttgatctcttagaaatcattgctaaagatggacctggtgctcaaatttctcctagtgaaactgcttctcagctcccaacatgcaccagttatgtgggaccgtatgttgtgtcgcttggcttgttacaatatcctcacttgttcagttcgtactcaacaagatggaaaggttcagagactttatggtttggctactgtggctaa

SEQ ID NO: 23634 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgtttttaaaatcagctcttgaacttgatctcttagaaatcattgctaaagctggacctggtgctcaaatttcacctattgacattgcttctcagctctcaacaacctgatgcaccagttatgttgaaccgaatgttgcgtcacttggcttgttacaatatactcacttgttcagttcgtactcaacaagatggaaagattcagagtctttatggtttcgctactgtagctaa

SEQ ID NO: 23635 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgtttttaaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23636 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttttaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23637 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgtaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23638 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaagtcagctcttgaacttgatctcttagaaatcattgctaaagctggacctggtgctcaaatttcacctattgaaattgcttctcagctcccaacaaccctgatgcaccagttatgttggaccggatgttgcgtctcttggcttgttacaatatcctcacttgttcagttcgtactcaacaagatggaaaggttcagagactttatggtttggctactgttgctaa

SEQ ID NO: 23639 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaagtcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23640 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaattagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23641 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcggctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23642 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcggctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaagattcagagactgtatggtttggctactgttgctaa

SEQ ID NO: 23643 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttggcttgttacaatatcctcacttgttcagttcgtactcaacaagatggaaaggttcagagactttatggtttggctactgttgctaa

SEQ ID NO: 23644 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttggcttgttacaatatcctcacttgttcagttcgtactcaacaagatggaaagattcagagactttatggtttggctactgttgctaa

SEQ ID NO: 23645 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgcacttgatctcttagaaatcattgctaaagctggacctggtgctcaaatttcacctattgaaattgcttctcagctcccaacaactatgcaccagttatgttggaccgaatgttgcgtcgcttggcttgttacaatatcctcacttgtgcagttcgtactcaacaagatggaaaggttcagagactttatggtttggctactgttgctaa

SEQ ID NO: 23646 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgatcttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 23647 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgatcttgatctacaagatggaaagattcagagactttatggtttggctactgttgctaa

SEQ ID NO: 23648 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgacttgttacaatatcctcacttgttcagttcgtactcaacaagatggaaaggttcagagactttatggtttggctactgttgctaa

SEQ ID NO: 23649 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgacttgttacaatatcctcacttgttcagttcgtactcaacaagatggaaagattcagagactttatggtttggctactgttgctaa

SEQ ID NO: 23650 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcttttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaagattcagagactttatggtttggctactgttgctaa

SEQ ID NO: 23651 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 23652 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggaccgaatgttgcgtctcttggcttgttacaatatcctcacttgttcagttcgtactcaacaagatggaaagattcagagactttatggtttggctactgttgctaa

SEQ ID NO: 23653 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggaccgaatgttgcgtctcttggcttgttacaatatcctcacttgttcagttcgtactcaacaagatggaaaagttcagagactttatggtttggctactgttgctaa

SEQ ID NO: 23654 - DNA, 250 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggcttgttacaatatcctcacttgttcagttcgtactcaacaagatggaaaggttcagagactttatggtttggctactgttgctaac

SEQ ID NO: 23655 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggcttgttacaatatcctcacttgttcagttcgtactcaacaagatggaaaggttcagagactttatggtttggctactgttgctaa

SEQ ID NO: 23656 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggcttgttacaatatcctcacttgttcagttcgtactcaacaagatggaaagattcagagactttatggtttggctactgttgctaa

SEQ ID NO: 23657 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggcttgttacaatatcctcacttgttcagttcgtactcaacaagatggaaaagttcagagactttatggtttggctactgttgctaa

SEQ ID NO: 23658 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggcttgttacaatatcctcacttgttcagttcgtactaaacaagatggaaaggttcagagactttatggtttggctactgttgctaa

SEQ ID NO: 23659 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23660 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23661 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagacatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23662 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaattcattgctcaagctggacctggtgctcaaatttcacctattgaaattgcttctcagctaccaacaactgatgcaccagttatgttggacagaatgttgcgtctcttggcttgttacactatcctcacttgttcagttcgtactcaacaagatggaaaggttcagagactttatggtttggctactgttgctaa

SEQ ID NO: 23663 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagtcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23664 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23665 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23666 - DNA, 293 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 23667 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23668 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctttgctaaagctggacctggtgctcaaatttcacctattgaaattgcttctcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23669 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgttaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23670 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggtaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23671 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgcttaagctggacctggtgctcaaatttcacctattgaaattgcttctcagctcccaacaactgaggaagcggaagagcgcccaatacgcaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23672 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23673 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23674 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagttggaccgaatgttgcgtctcttggcttgttacaatatcctcacttgttcagttcgtactcaacaagatggaaaagttcagagactttatggtttggctactgttgctaa

SEQ ID NO: 23675 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctgtacctggtgctcaaatttcacctattgaaattgcttctcagctcccaacaaatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 23676 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggccctggtgctcaaatttcacctattgaaattgcttctcagctcccaacaatgatgcaccagttatgttagaccgattgttgcgtctcctggcatgtgacaatatcctcacttgttcattccgtactcaacaagatggaaaggttcagagactttatggtttggctactgttgctaa

SEQ ID NO: 23677 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggatctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23678 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggatctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23679 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23680 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23681 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23682 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23683 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcttaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23684 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcttaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23685 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctctaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23686 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctctaatttcacctattgaaattgcttctcagctcccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 23687 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23688 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23689 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 23690 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaggttcagagactttatggtttggctactgttgctaa

SEQ ID NO: 23691 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaaggtggaaagattcagagactttatggtttggctactgttgctaa

SEQ ID NO: 23692 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttgacctattgaaattgcttctcagctcccaacaactaccggcaacagtcgctggaccgtctccagcaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 23693 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttctcctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23694 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttctcctattgaaattgcttctcagctaccaacgcaccagttatgttggaccgaatgttgcgtctcttggcttgttacaatatcctcacttgttcagttcgtactcaacaagatggaaaagttcagagactttatggttcggctactgttgctaa

SEQ ID NO: 23695 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23696 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctattgaaattgcttctcagctaccatgcaccagttatgttggaccgaatgttgcgtctcttggcttgttacaatatcctcacttgttcagttcgtactcaacaagatggaaaggttcagagactttatggtttggatactgttgctaa

SEQ ID NO: 23697 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23698 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcccctattgaaattgcttctcagctcccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23699 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcatctattgaaattgcttctcagctaccaactgatgcaccagttatgttggtccgaatgttgcgactcttggcttgttacaatatcctcacttgttcagttcgtactcaacaagatggaaaggttcagagactttatggtttggctactgttgctaa

SEQ ID NO: 23700 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacttattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23701 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcactgtcaccgaatgttgcgtctcttggcttgttacaatatcctcacttgttcagttcgtactcaacaagatggaaaggttcagagactttatggtttggctactgttgctaa

SEQ ID NO: 23702 - DNA, 328 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttaagttcgtactcaacaagatggaaaggttcagagactttatggttggctactgttgctaa

SEQ ID NO: 23703 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 23704 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23705 - DNA, 328 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttaaaaatccccccctggtcagttcgtactcaacaagatggaaaggttcagagactttatggtttggctactgttgctaa

SEQ ID NO: 23706 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcaccttttgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23707 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttgaaattgcttctcagctcccaacaactaaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23708 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcagattgcttctcagctaccagttatgttggaccgaatgttgcgtctcttggcttgttacaatatcctcacttgttcagttcgtactcaacaagatggaaagattcagagactttatggtttggctactgttgctaa

SEQ ID NO: 23709 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcttggcttgttacaatatcctcacttgttctgttcgtactcaacaagatggaaaggttcagagactttatggtttggctactgttgctaa

SEQ ID NO: 23710 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcttggcttgttacaatatcctcacttgttcagttcgtactaaacaagatggaaaggttcagagactttatggtttggctactgttgctaa

SEQ ID NO: 23711 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23712 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23713 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaactctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 23714 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23715 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23716 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23717 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactttgctaa

SEQ ID NO: 23718 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23719 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23720 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23721 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 23722 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23723 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23724 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23725 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23726 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23727 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 23728 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23729 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23730 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23731 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttctgttcgtactcaacaagatggaaaggttcagagactttatggtttggctactgttgctaa

SEQ ID NO: 23732 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaacccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23733 - DNA, 288 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacgtactcaacacgatggaaggttcagagactttatggtttggctactgttgctaa

SEQ ID NO: 23734 - DNA, 288 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgcta

SEQ ID NO: 23735 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 23736 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23737 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23738 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23739 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 23740 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 23741 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 23742 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23743 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 23744 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttcagttcgtactcaacaagatggaaagattcagagactttatggtttggctactgttgctaa

SEQ ID NO: 23745 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttctgttcgtactcaacaagatggaaaggttcagagactttatggtttggctactgttgctaa

SEQ ID NO: 23746 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23747 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23748 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23749 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23750 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23751 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23752 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23753 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacacatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 23754 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23755 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23756 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23757 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23758 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23759 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23760 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23761 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23762 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 23763 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23764 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23765 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23766 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23767 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23768 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23769 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23770 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23771 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttctgttcgtactcaacaagatgtaaaggttcagagactttatggtttggctactgttgctaa

SEQ ID NO: 23772 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23773 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagactttatggtttggctactgttgctaa

SEQ ID NO: 23774 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23775 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattggaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 23776 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgagattgcttctcagctaccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 23777 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 23778 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23779 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgacattgcttctcagctaccaacatgcaccagttatgttggaccgaatgttgcgtctcttggcttgttacaatatcctcacttgttcagttcgtactcaacaagattgaaaggttcagagacattatggtttggctactgttgctaa

SEQ ID NO: 23780 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23781 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaacttgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23782 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaaggttcagagactttatggtttggctactgttgctaa

SEQ ID NO: 23783 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaagattcagagactttatggtttggctactgttgctaa

SEQ ID NO: 23784 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 23785 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaagattcagagactttatggtttggctactgttgctaa

SEQ ID NO: 23786 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcggctcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23787 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcggctaccaacaactctgatgcaccagttatgttggaccgaatgttgcgtctcttggcttgttacaatatcctcacttgttcagttcgtactcaacaagatggaaaagttcagagactttatggtttggctactgttgcaa

SEQ ID NO: 23788 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23789 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23790 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagttcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23791 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttcagttcgtactcaacaagatggaaaggttcagagactttatggtatggctactgttgctaa

SEQ ID NO: 23792 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23793 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23794 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23795 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtacccaacaagatggaaagattcagagactttatggtttggctactgttgctaa

SEQ ID NO: 23796 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23797 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23798 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23799 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 23800 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23801 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23802 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 23803 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttctgttcgtactcaacaagacggaaaggttcagagactgtatggtttggctactgttgctaa

SEQ ID NO: 23804 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23805 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23806 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcagcaagatggaaaagttcagagactttatggtttggctactgttgctaa

SEQ ID NO: 23807 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaagttcagagactttatggtttggctactgttgttaa

SEQ ID NO: 23808 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 23809 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23810 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 23811 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23812 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23813 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23814 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23815 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcctaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23816 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23817 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23818 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23819 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23820 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23821 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23822 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23823 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23824 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23825 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23826 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgacgcaccagttatgttggaccgaatgttgcgtctcttggcttgttacaatatcctcacttgttcagttcgtactcaacaagatggaaagattcagagactttatggtttggctactgttgctaa

SEQ ID NO: 23827 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaaagttcagagactttatggtttggctactgttgctaa

SEQ ID NO: 23828 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaggtgtacggctacaggggcaagcgcctgggcggctccagatgcacccgttatgttggaccgaatgttgcgtctcttggcttgttacaatatcctcacttgttcagttcgtactcaacaagatggaaaggttcagagactttatggtttggctactgttgctaa

SEQ ID NO: 23829 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23830 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23831 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23832 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 23833 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 23834 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23835 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 23836 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23837 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23838 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23839 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23840 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 23841 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacctgatgtaccagttatgttggaccgaatgttgcgtctcttggcttgttacaatatcctcacttgttcagttcgtactcaacaagatggaaaggttcagagcctttagggtttgctactgttgctaa

SEQ ID NO: 23842 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23843 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23844 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23845 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgcta

SEQ ID NO: 23846 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23847 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23848 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaagattcagagactttatggtttggctactgttgctaa

SEQ ID NO: 23849 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatttatgttggaccgaatgttgcgtctcttggcttgttacaatatcctcacttgttcagttcgtactcaacaagatggaaaggttcagagactttatggtttggctactgttgctaa

SEQ ID NO: 23850 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaagattcagagactttatggtttggctactgttgctaa

SEQ ID NO: 23851 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaaggttcagagactttatggtttggctactgttgctaa

SEQ ID NO: 23852 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23853 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagacattatggtttggctactgttgctaa

SEQ ID NO: 23854 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 23855 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaagttcagagcctttatggtctggctactgttgctaa

SEQ ID NO: 23856 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23857 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgtgtctcttggcttgttacaatatcctcacttgttcagttcgtactcaacaagatggaaaggttcagagactttatggtttggctactgttgctaa

SEQ ID NO: 23858 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23859 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtacccaacaagatggaaagattcagagactttatggtttggctactgttgctaa

SEQ ID NO: 23860 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23861 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23862 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23863 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttgtctactgttgctaa

SEQ ID NO: 23864 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23865 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 23866 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23867 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23868 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgatcagttcgtactcaacaagatggaaaggttcagagactttatggtttggctactgttgctaa

SEQ ID NO: 23869 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23870 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23871 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaagttcagagactttatggtttggctactgttgctaa

SEQ ID NO: 23872 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 23873 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatgtaaagattcagagactttatggtttcgctactgttgctaa

SEQ ID NO: 23874 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaggtggtggccatcgccagcaataatggtggcaagcaggcgctggagacggtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23875 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23876 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23877 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23878 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23879 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctacttttgctaa

SEQ ID NO: 23880 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23881 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23882 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23883 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcactggttcagttcgtactcaacaagatggaaaagttcagagactttatggtttggctactgttgctaa

SEQ ID NO: 23884 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 23885 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23886 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23887 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23888 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23889 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23890 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23891 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaaggttcagagactttatggtttggctactgttga

SEQ ID NO: 23892 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23893 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23894 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaagattcagagactttatggtttggctactgttgctaa

SEQ ID NO: 23895 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaaggttcagagactttatggtttggctactgttgctaa

SEQ ID NO: 23896 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaaggttcagagactttatggtttggctactgttgctaa

SEQ ID NO: 23897 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaaagttcagagactttatggtttggctactgttgctaa

SEQ ID NO: 23898 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaagattcagagactttatggtttggctactgttgctaa

SEQ ID NO: 23899 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaaggttcagagactttatggtttggctactgttgctaa

SEQ ID NO: 23900 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaagattcagagactttatggtttggctactgttgctaa

SEQ ID NO: 23901 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 23902 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaagattcagagactttatggtttggctactgttgctaa

SEQ ID NO: 23903 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23904 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttctaa

SEQ ID NO: 23905 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23906 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 23907 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23908 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23909 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23910 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagtccgtactcaacaagatggaaagattcagagactttatggtttggctactgttgctaa

SEQ ID NO: 23911 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23912 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23913 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23914 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 23915 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatacaccagttatgttggaccgaatgttgcgtctcttggcttgttacaatatcctcacttgttcagttcgtactcaacaagatggaaagattcagagactttatggtttggctactgttgctaa

SEQ ID NO: 23916 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagttatgttggaccgaatgttgcgtctcttggcttgttacaatatcctcacttgttcagttcgtactcaacaagatggaaaggttcagagactttatggtttggctactgttgctaa

SEQ ID NO: 23917 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagatggaaaggttcagagactttatggtttggctactgttgctaa

SEQ ID NO: 23918 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 23919 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 23920 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttctgttcgtactcaacaagatggaaagattcagagactttatggtttggctactgttgctaa

SEQ ID NO: 23921 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23922 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23923 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactttgtgcacgacgacatcattccgtggcgttatccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 23924 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactttgtgcacgacgacatcattccgtggcgttatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23925 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaagattcagagactttatggtttggctactgttgctaa

SEQ ID NO: 23926 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttctgttcgtactcaacaagatggaaaggttcagagactttatggtttggctactgttgctaa

SEQ ID NO: 23927 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaaggttcagagactttatggtttggctactgttgctaa

SEQ ID NO: 23928 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaagattcagagactttatggtttggctactgttgctaa

SEQ ID NO: 23929 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23930 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23931 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatccgcacttgttcagttcgtactcaacaagatggaaagattcagagactttatggtttggctactgttgctaa

SEQ ID NO: 23932 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23933 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaagattcagagactttatggtttggctactgttgctaa

SEQ ID NO: 23934 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaggttcagagactttatggtttggctactgttgctaa

SEQ ID NO: 23935 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaagattcagagactttatggtttggctactgttgctaa

SEQ ID NO: 23936 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactggcacagcaccggcaacagccgctggaccctgatgcaccagttatgatggaccgaatgttgcgtctcttggcttgttacaatatcctcacttgttcagttcgtactcaacaagatggaaagattcagagactttatggtttggctactgttgctaa

SEQ ID NO: 23937 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaagattcagagactttatggtttggctactgttgctaa

SEQ ID NO: 23938 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaaggttcagagactttatggtttggctactgttgctaa

SEQ ID NO: 23939 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 23940 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaaagttcagagactttatggtttggctactgttgctaa

SEQ ID NO: 23941 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgtaccagttatgttggaccgaatgttgcgtctcttggcttgttacaatatcctcacttgttcagttcgtactcaacaagatggaaagattcagagactttatggtttggctactgttgtaa

SEQ ID NO: 23942 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23943 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23944 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttgtcttgttacaatatcctcacttgttcagttcgtactcaacaagatggaaagattcagagactttatggtttggctactgttgctaa

SEQ ID NO: 23945 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgtggcgtctcttggcttgttacaatatcctcacttgttcagttcgtactcaacaagatggaaagattcagagactttatggtttggctactgttgctaa

SEQ ID NO: 23946 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23947 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23948 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttcctaa

SEQ ID NO: 23949 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttgctactgttgctaa

SEQ ID NO: 23950 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttagggtttggctactgtctaa

SEQ ID NO: 23951 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatggtgcgtctcttggcttgttacaatatcctcacttgttcagttcgtactcaacgagatggaaaggttcagagactttatggtttggctactgttgctaa

SEQ ID NO: 23952 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttattacaatatcctcacttgttcagttcgtactcaacaagatggaaaagttcagagactttatggtttggctactgttgctaa

SEQ ID NO: 23953 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 23954 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgaggaagcggaagagcgcccaatacgcaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23955 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgaggaagcggaagagcgcccaatacgcaaaccatgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 23956 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23957 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23958 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23959 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23960 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttctgttcgtactcaacaagatggaaaggttcagagactttatggtttggcgactgttgctaa

SEQ ID NO: 23961 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23962 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23963 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23964 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23965 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaaggttcagagactttatggtttggctactgttgctaa

SEQ ID NO: 23966 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23967 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23968 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23969 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaggcaacagcgcctgcaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23970 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactagctggaccgtctccagcgcctgcttgccgccatcgtggctggcgatggccaccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23971 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactagccggtgctgtgccaggcccacggcttgaccccggagcaggtggtggccatcgcctggcacagcaccggcaacagccgctggatgcatcagttatgttggaccgaatgttgcgtctcttggcttgttacaatatcctcacttgttcagttcgtactcaacaagatggaaaggttcagagactttatggtttggctactgttgctaa

SEQ ID NO: 23972 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaagattcagagactttatggtttggctactgttgctaa

SEQ ID NO: 23973 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactacttgaccccggagcaggtggtggccatcgccggccacgatggcggcaacagccgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23974 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacagcaccggcaacaggcgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23975 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23976 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23977 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23978 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaaggttcagagactttatggtttggctactgttgctaa

SEQ ID NO: 23979 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23980 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23981 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 23982 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 23983 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttctgttcgtactcaacaagatggaaaggttcagagactttatggtttggctactgttgctaa

SEQ ID NO: 23984 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 23985 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23986 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactgaacaagatggaaagattcagagactttatggtttggctactgttgctaa

SEQ ID NO: 23987 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23988 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23989 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 23990 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccggcagcagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23991 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23992 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgttggaccgaatgttgcgtctcttggcttgttacaatatcctcacttgttcagttcgtactcaacaagatggaaaggttcagagactttatggtttggctactgttgctaa

SEQ ID NO: 23993 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 23994 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggattgttacaatatcctcacttgttctgttcgtactcaacaagatggaaaggttcagagactttatggtttggctactgttgctaa

SEQ ID NO: 23995 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 23996 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23997 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 23998 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 23999 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24000 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttgctaa

SEQ ID NO: 24001 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgttatgttggaccgaatgttgcgtctcttggcttgttacaatatcctcacttgttcagttcgtactcaacaagatggaaaggttcagagactttatggtttggctactgttgctaa

SEQ ID NO: 24002 - DNA, 377 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacggcaagcaggcgctggagaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24003 - DNA, 377 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacggcaagcaggcgctggagaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24004 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24005 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24006 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24007 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24008 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24009 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24010 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24011 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 24012 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24013 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24014 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 24015 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 24016 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 24017 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccgtgggcctggcacagcaccggcaacagcgcctgcaccgtctccagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24018 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatggaccagttatgttggaccgaatgttgcgtctcttggcttgttacaatatcctcacttgttcagttcgtactcaacaagatggaaaggttcagagactttatggtttggctactgttgctaa

SEQ ID NO: 24019 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24020 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24021 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 24022 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24023 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 24024 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24025 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatgggttggctactggttgctaa

SEQ ID NO: 24026 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 24027 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggacccaatgttgcgtctcttggcttgttacaatatcctcactttttccgttcgtactcaacaagatggaaaagttcagagactttatggtttggctactgttgctaa

SEQ ID NO: 24028 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 24029 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 24030 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24031 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24032 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24033 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24034 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24035 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24036 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24037 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24038 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24039 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaagattcagagactttatggtttggctactgttgctaa

SEQ ID NO: 24040 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacacggatggcctttttgcgtttctacaaactcttcctggctagcggtacgcgtattaattgcgttgcgctcactgcccgctttccagtcgggaaacctgtcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24041 - DNA, 462 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacaccccccagcaggtggtggccagcgccagcaatggcggtggcaagcaggcgctggagacggtccagcggctgttgccggtgctgtgccaggcccacggcttctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24042 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacaccccccagcaggtggtggccatcgccagcaataatggtggcaagcaggcgctggagacggtccagcggctgttgccggtgctgtgccaggcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24043 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24044 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24045 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24046 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24047 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 24048 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24049 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaaccagatggaaagattcagagactttatggtttggctactgttgctaa

SEQ ID NO: 24050 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagatcgtactcaacaagatggaaaggttcagagactttatggtttggctactgttgctaa

SEQ ID NO: 24051 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaagattcagagactttatggtttggctacgttgctaa

SEQ ID NO: 24052 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24053 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggctactgttgctaa

SEQ ID NO: 24054 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcatcctcacttgttcagttcgtactcaacaagatggaaaggttcagagactttatggtttggctactgttgctaa

SEQ ID NO: 24055 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaaggttcagagactttatggtttggctactgttgctaa

SEQ ID NO: 24056 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24057 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24058 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24059 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24060 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24061 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24062 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatccgcacttgttcggttcggactcaacaagatggaaagattcagagtctttatggtttggctactgttgctaa

SEQ ID NO: 24063 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 24064 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24065 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24066 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24067 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaagattcagagactttatggtttggctactggtgctaa

SEQ ID NO: 24068 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaagattcagagactttatggtttggctactgttgctaa

SEQ ID NO: 24069 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24070 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24071 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 24072 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24073 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24074 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24075 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaaagttcagagactttatggtttggctactgttgctaa

SEQ ID NO: 24076 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24077 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24078 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24079 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24080 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24081 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaggttcagagactttatggtttggctactgttgctaa

SEQ ID NO: 24082 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaagattcagagactttatggtttggctactgttgctaa

SEQ ID NO: 24083 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaaggttcagagactttatggtttggctactgttgctaa

SEQ ID NO: 24084 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24085 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24086 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24087 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24088 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24089 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24090 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgtttcaatatcctcacttgttcagttcgtactcaacaagatggaaaggttcagagactttatggtttgctactgttgctaa

SEQ ID NO: 24091 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24092 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaaggttcagagactttatcgtttggctactgttgctaa

SEQ ID NO: 24093 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24094 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaagattcagagactttatggtttggctacggttgctaa

SEQ ID NO: 24095 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24096 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24097 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctacttgcta

SEQ ID NO: 24098 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24099 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 24100 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24101 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24102 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24103 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24104 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaaggttcagagactttatggtttggctactgttgctaa

SEQ ID NO: 24105 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 24106 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24107 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24108 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24109 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaaggttcagagactttatggtttggctactgttgctaa

SEQ ID NO: 24110 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacgaccctgatgcaccagttatgttggaccgaatgttgcgtctcttggcttgttacaatatcctcacttgttcagttcgtactcaacaaggtggaaagattcagagactttatggtttggctactgtagctaa

SEQ ID NO: 24111 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24112 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgatacaatatcctcacttgttcagttcgtactcaacaagatggaaaagttcagagactttatggtttggctactgttgctaa

SEQ ID NO: 24113 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24114 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24115 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24116 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24117 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaagttcagagactttatggtttggctactgttctaa

SEQ ID NO: 24118 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24119 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24120 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24121 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24122 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagtttgtactcaacaagatggaaaggttcagagactttatggtttggctactgttgctaa

SEQ ID NO: 24123 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgcactcaacaagatggaaaggttcagagactttatggtttggctactgttgctaa

SEQ ID NO: 24124 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcatgttacaatatcctcacttgttcagttcgtactcaacaagatggaaaggttcagagactttatggtttggggactgttgctaa

SEQ ID NO: 24125 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24126 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgccgctcttggcttgttacagtatactcacttgttcagttcgtactcaacaagacggaaaggttcagagactttatggtttggctactgttgctaa

SEQ ID NO: 24127 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtcactcggcatgttacaatatcctcacttgttcagttcgtactcaccaagactaaaaggttcagagactgtatggtttggctactgttactaa

SEQ ID NO: 24128 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24129 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24130 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24131 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24132 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttctgttcgtactcaacaagatggaaaggttcagagactttatggtttggctactgtgctaa

SEQ ID NO: 24133 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 24134 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatggtggaccgaatgttgcgtctcttggcttgttacaatatcctcacttgttcagttcgtactcaacaagatggaaaggttcagagactttatggtttggctactgttgctaa

SEQ ID NO: 24135 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24136 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatcctgatgcaccagttatgttgtaccgaatgttgcgtctcttggcttgttacaatatcctcacttgttcagttcgtactcaacaagatggaaaggttcagagcctttatggtttggctactgttgctaa

SEQ ID NO: 24137 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccatttatgttggaccgaatgttgcgtctcttggctttttacaatatcctcacttgttcagttcgtactcaacaagatggaaagattcagagactttatggtttggctactgttgctaa

SEQ ID NO: 24138 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24139 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24140 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24141 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 24142 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagttggaaaggttcagagactttatggtttggctactgttgctaa

SEQ ID NO: 24143 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24144 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24145 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24146 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttctgttcgtactcaacaagatggaaagattcagagactttatggtttggctactgttgctaa

SEQ ID NO: 24147 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaggttcagagactttatggtttggctactgttgctaa

SEQ ID NO: 24148 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24149 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacacgcaccagttatgttggaccgaatgttgcgtctcttggcttgttacaatatcctcacttgttcagttcgtactcaacaagatggaaagattcagagactttatggtttggctactgttgctaa

SEQ ID NO: 24150 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24151 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24152 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24153 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 24154 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactggtgctaa

SEQ ID NO: 24155 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 24156 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttctgttcgtactcaacaagatggaaaggttcagagactttatggtttggctactgttgctaa

SEQ ID NO: 24157 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 24158 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagaccttatggtttggctactgttgctaa

SEQ ID NO: 24159 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagtcatgttggaccgaatgttgcgtctcttggcttgttacaatatcctcacttgttcagttcgtactcaacaagatggaaagattcagagactttatggtttggctactgttgctaa

SEQ ID NO: 24160 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaattttatgttggaccgaatgttgcgtctcttggcttgttacaatatcctcacttgttcagttcgtactcaacaagatggaaaggttcagagactttatggtttggctactgttgctaa

SEQ ID NO: 24161 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaaggttcagagactttatggtttggctactgttgctaa

SEQ ID NO: 24162 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24163 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24164 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24165 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24166 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24167 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttactatatcctcacttgttcagttcgtactcaacaagatggaaaagttcagagactttatggtttggctactgttgctaa

SEQ ID NO: 24168 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatagaaaggttcagagactttatggtttggctactgttgctaa

SEQ ID NO: 24169 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24170 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24171 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24172 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24173 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctctgttgctaa

SEQ ID NO: 24174 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24175 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24176 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 24177 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatatgttgcgtctcttggcttgttacaatatcctcacttgttcagttcgtactcaacaagatggaaagattcagagactttatggtttggctactgttgctaa

SEQ ID NO: 24178 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagattttatggtttggctactgttgctaa

SEQ ID NO: 24179 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24180 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 24181 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaagttcagagactttatggtttggctactgttgctaa

SEQ ID NO: 24182 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 24183 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttctgttcgtactcaacaagatggaaagattcagagactttatggtttggctactgttgctaa

SEQ ID NO: 24184 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24185 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcatggcttgttacaatatcctcacttgttcagttcgtactcaacaagatggaaagattcagagactttatggtttggctactgttgctaa

SEQ ID NO: 24186 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 24187 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24188 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctag

SEQ ID NO: 24189 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24190 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatggtttggctactgttgctaa

SEQ ID NO: 24191 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatgatttggctactgttgctaa

SEQ ID NO: 24192 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaagattcagagactttatggtttggctactgttgctaa

SEQ ID NO: 24193 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttggctactgttgctaa

SEQ ID NO: 24194 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 24195 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24196 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtcgcttggcttgttacaatatcctcacttgttcagttcgtactcaacaagatggaaaggttcagagactttgtggtttggcgactggtggtaa

SEQ ID NO: 24197 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24198 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 24199 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagactttatggtttggctactgttgctaa

SEQ ID NO: 24200 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttatcccctgattctgtggataaccgtattaccgcctttgagtgagccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24201 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactggcacagcaccggcaacagccgctggaccgtctccagcaccagttatgttggaccgaatgttgcgtctcttggcttgttacaatatcctcacttgttcagttcgtactcaacaagatggaaaggttcagagactttatggtttggctactgttgctaa

SEQ ID NO: 24202 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgcgctggggacggtccaggcgctgtggccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24203 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtgcaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24204 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtgcaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24205 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtccaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24206 - DNA, 448 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtggcaggcccacggcttgaccccggagcaggtggtggccatcgccagcaatattggtggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24207 - DNA, 448 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtgccaggcccacggcttgaccccggagcaggtggtggccatcgccagcaatattggtggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24208 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 24209 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgactcttggcttgttacaatatcctcacttgttcagttcgtactcaacaagatggaaagattcagagactttatggtttggctactgttgctaa

SEQ ID NO: 24210 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatttgtcctactcaggagagcgttcaccgacaaacaacagataaaacgaaaggcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24211 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatttgtcctactcaggagagcgttcaccgacaaacaacagataaaacgaaaggcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24212 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatttgccctactcaggagagcgttcaccgacaaacaacagataaaacgaaaggcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24213 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24214 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24215 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24216 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24217 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggacagaatgttgcgtctcttggcttgttacaatatcctcacttgttcagttcgtactcaacaagatggaaaggttcagagactttatggtttggctactgttgctaa

SEQ ID NO: 24218 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtcgcttggcttgttacaatatcctcgcttgttcagttcgtactcaacaagatggaaaggttcagagactttatggtttggctactgttgctaa

SEQ ID NO: 24219 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtctggctactgttgctaa

SEQ ID NO: 24220 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgcta

SEQ ID NO: 24221 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 24222 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaagattcagagactttatggtttggctactgttgctaa

SEQ ID NO: 24223 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgagtctcttggcttgttacaatatcctcacttgttcagttcgtactcaacaagatggaaaggttcagagactttatggtttggctactgttgctaa

SEQ ID NO: 24224 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcccttgttcagttcgtactcaacaagatggaaaggttcagagacgttatggtttggctactgttgctaa

SEQ ID NO: 24225 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagtccgtacccaacaagatggaaagattcagagactttatggtttggctactgttgctaa

SEQ ID NO: 24226 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 24227 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcccttgttcagttcgtacttaacaagatggaaaggttcagagactttatggtttggctactgttgctaa

SEQ ID NO: 24228 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 24229 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttaccatatcctcacttgttcagttcgtactcaacaagatggaaagattcagagactttatggtttggctactgttgctaa

SEQ ID NO: 24230 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcactttttcagttcgtactcaacaagatggaaaggttcagagactttatggtttggctactgttgctaa

SEQ ID NO: 24231 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaacgaatgttgcgtctcttggcttgttacaatatcctcacttgttcagttcgtactcaacaagatggaaaggttcagagactttatggtttggctactgtgctaa

SEQ ID NO: 24232 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 24233 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 24234 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcggctcttggcttgttacaatatcctcacttgttcagttcgtactcaacaagatggaaaagttcagagactttatggtttggctactgttgctaa

SEQ ID NO: 24235 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttacgttggaccgaatgttgcgtctcttggcttgttacaatatcctcacttgttcagttcgtactcaacaagatggaaagattcagagactttatggtttggctactgttgctaa

SEQ ID NO: 24236 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24237 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24238 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgacggatggcctttttgcgtttctacaaactcttcctggctagcggtaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 24239 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgacggatggcctttttgcgtttctacaaactcttcctggctagcggtaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24240 - DNA, 402 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgaagaagatcgcttggcctcgcgcgcagatcagttggaagaatttgtccactacgtgaaaggcgagatcaccaatctcttggcttgttacaatatcctcacttgttcagttcgtactcaacaagatggaaagattcagagactttatggtttggctactgttgctaa

SEQ ID NO: 24241 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccatttatgttggaccgaatgttgcgtctcttggcttgttacaatatcctcacttgttcagttcgtactcaacaagatggaaagcttcagagactttgtggtttggctactgttgctaa

SEQ ID NO: 24242 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24243 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24244 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24245 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24246 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctctgggcttgttacaatatcctcacttgttcagttcgtactcaacaagatggaaaggttcagagactttatgggttggctactgttgctaaa

SEQ ID NO: 24247 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 24248 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatgttttggctactgttgctaa

SEQ ID NO: 24249 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctccaggggaagccgaagtttccaaaaggtcgttgatcaaagctcgccgcgttgtttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24250 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactcgtaaccgtatcgatatgctctcaaccggcattaaaagcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24251 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24252 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24253 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24254 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24255 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaagattcagagactttatggtttggctactgttgctaa

SEQ ID NO: 24256 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24257 - DNA, 439 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactatgccggtgctgtgccaggcccacggcttgaccccggagcaggtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24258 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24259 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24260 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 24261 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 24262 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaggcaacagcgactggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24263 - DNA, 441 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaggacaggtatccggtaagcggcaaggtcggaacaggagagcgcacgagggagcttccagggggaaacgcctggtatctttaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24264 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactagcgtgactgagttcaagttcctgttcgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24265 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24266 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24267 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactagccaggcccacggcttgaccctgatgcaccagtgatgttggaccgaatgtggcgtctcgtggcttgttacaatatccgcacttgttcagttcgtactcaacaagatggaaaagttcagagactttatggtttggctactggtgctaa

SEQ ID NO: 24268 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24269 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24270 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24271 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactacggctacactagaagaacagtatttggtatctgcgctctgctgaagccagttaccttcggaaaaagagttggtagctcttgatccggcaaacaaaccaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24272 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24273 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24274 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24275 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24276 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24277 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaccagttatgttggaccgaatgttgcgtctcttggcttgttacaatatcctcacttgttcagttcgtactcaacaagatggaaagattcagagactttatggtttggctactgttgctaa

SEQ ID NO: 24278 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24279 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24280 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24281 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaagccgtgggcctggcacagcaccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24282 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaagccgtgggcctagcacggcaccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24283 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24284 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttctgttcgtactcaacaagatggaaaggttcagagactttatggtttggctactgttgctaa

SEQ ID NO: 24285 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 24286 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaagttcagagactttatggtttggctactgttgctaa

SEQ ID NO: 24287 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24288 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttattcagttcgtactcaacaagatggaaaagttcagagactttatggtttggctactgttgctaa

SEQ ID NO: 24289 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 24290 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 24291 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24292 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24293 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24294 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaagttcagagactttatggtttggctactgtggctaa

SEQ ID NO: 24295 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24296 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24297 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24298 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24299 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24300 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccgaacaggcttatgtccactgggtgcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 24301 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctggaggaggtgaggaggaagttcaacaacggcgagatcaacttcgcggccgactgataactcgagaagggcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24302 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24303 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24304 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24305 - DNA, 472 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccccggagcaggtgcgggccatcgccagcaatattggtggcaagcaggcgctggagacggtgcaggcgctgttgccggtgctgtgccaggcccacggcttgaccccccagcatgcaccagttatgttggaccgaatgttgcgtctcttggcttgttacaatatcctcacttgttcagttcgtactcaacaagatggaaagattcagagactttatggtttggctactgttgctaa

SEQ ID NO: 24306 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24307 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccatatttttttattttttttatttttcaaacctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 24308 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 24309 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 24310 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaggttcagagactttatggtttggctactgttgctaa

SEQ ID NO: 24311 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaagttcagagactttatggtttggctactgttgctaa

SEQ ID NO: 24312 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24313 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24314 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacagataaaacgaaaggcccagtcttctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24315 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacaccattattgctggcgatggccaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24316 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24317 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24318 - DNA, 366 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 24319 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24320 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgtactcaacaagatggaaaggttcagagactttatggtttggctactgttgctaa

SEQ ID NO: 24321 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 24322 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24323 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24324 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24325 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24326 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24327 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24328 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24329 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24330 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggctggttacaatatcctcacttgttcagttcgtactcaacaagatggaaagattcagagactttatggtttggctactgttgctaa

SEQ ID NO: 24331 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 24332 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttataatatcctcacttgttctgttcgtactcaacaagatggaaaggttcagagactttatggtttggctactgttgctaa

SEQ ID NO: 24333 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttttggtttggctactgttgctaa

SEQ ID NO: 24334 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtctggctactgttgctaa

SEQ ID NO: 24335 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtattcaacaagatggaaagattcagagactttatggtttggctactgttgctaa

SEQ ID NO: 24336 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 24337 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 24338 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 24339 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgttctcaacaagatggaaaagttcagagactttatggtttggctactgttgctaa

SEQ ID NO: 24340 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggtccgaatgttgcgtctcttggcttgttacaatatccacacttgttcagttcgtactcaacaagatggaaaggttcagagactttatggtttggctactgttgctaa

SEQ ID NO: 24341 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 24342 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 24343 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24344 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24345 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24346 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24347 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24348 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccgtctccagcggctgttgccgccgccattgctggcgatggccaccacctgctccggggtcaagccgtgggcctggcacagcaccggccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24349 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccgtctccagcggctgttgccgccgccattgctggcgatggccaccacctgctccggggtcaagccgtgggcctggcacagcaccggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24350 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24351 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24352 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24353 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24354 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctctgttgctaa

SEQ ID NO: 24355 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctact

SEQ ID NO: 24356 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactaaacaagatggaaaagttcagagactttatggtttggctactgttgctaa

SEQ ID NO: 24357 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctggtgctaa

SEQ ID NO: 24358 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 24359 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 24360 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcggagactttatggtttggctactgttgctaa

SEQ ID NO: 24361 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgatcagttcgtactcaacaagatggaaaagttcagagactttatggtttggctactgttgctaa

SEQ ID NO: 24362 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 24363 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24364 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24365 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 24366 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaaggttcagagactttatggtttggctactgttgcta

SEQ ID NO: 24367 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 24368 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccaacgagtggtggaaggtgtacccctccagcgtgaccgagttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24369 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaaggttcagagactttatggtttggctactgttgctaa

SEQ ID NO: 24370 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacatgatggaaagattcagagactttatggtttggctactgttgctaa

SEQ ID NO: 24371 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaagattcagagactttatggtttggctactgttgctaa

SEQ ID NO: 24372 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24373 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24374 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcactttttcagttcgtactcaacaagatggaaaggttcagagactttatggtttggctactgttgctaa

SEQ ID NO: 24375 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24376 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatattgcgtctcttggcttgttacaatatcctcacttgttcagttcgtactcaacaagatggaaagattcagagactttatggtttggctactgttgctaa

SEQ ID NO: 24377 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaggttcagagactttatggtttggctactgttgctaa

SEQ ID NO: 24378 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24379 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccggcaacagccgccggaccgtctccagcgccggcttgccaccattattgctggcgctggccaccacctgctggggggtcaagccgtgggcctggcacagcactactgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 24380 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttctgttcgtactcaacaagatggaaaggttcagagactttatggtttggctactgttgctaa

SEQ ID NO: 24381 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgctaa

SEQ ID NO: 24382 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 24383 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgcta

SEQ ID NO: 24384 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgtgacaatatcctcacttgttcagttcgtactcaacaagatggaaaagttcagagactttagggtttggctactgttgctaa

SEQ ID NO: 24385 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcatgttacaatatcctcacttgttcagttcgtactcaacaagatggaaaggttcagagactttatggtttggctactgttgctaa

SEQ ID NO: 24386 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24387 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24388 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcatctcttggcttgttacaatatcctcacttgttcagttcgtactcaacaagatggaaaggttcagagactttatggtttggctactgttgctaa

SEQ ID NO: 24389 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24390 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcggagactttatggtttggctactgttgctaa

SEQ ID NO: 24391 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgccaa

SEQ ID NO: 24392 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24393 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24394 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24395 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24396 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaagggtttacacacgcgcacatcgttgcgttaagccaacacccggcagcgttagggaccgtcgctgtcaagtatcaggacatgatcgcagcgttgccagaggcgacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24397 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24398 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24399 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24400 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactaaacaagatggaaaggttcagagactttatggtttggctactgttgctaa

SEQ ID NO: 24401 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24402 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 24403 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24404 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24405 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24406 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaggttcagagactttatggtttggctactgttgctaa

SEQ ID NO: 24407 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttccaatatcctcacttgttcagttcgtactcaacaagatggaaaagttcagagactttatggtttggctactgttgctaa

SEQ ID NO: 24408 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24409 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24410 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24411 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24412 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24413 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagccaccaacaactctgatgcaccagttatgttggaccgaatgttgcgtctcttgggttgttacaatatcctcacttgttcagttcgtactcaacaagatggaaagattcagagactttatggtttggctactgttgctaa

SEQ ID NO: 24414 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcacccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24415 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgtgtctcttggcttgttacaatatcctcacttgttcagttcgtactcaacaagatggaaaggttcagagactttatggtttggctactgttgctaa

SEQ ID NO: 24416 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaaggttcagagactttatggtttggctactggtgctaa

SEQ ID NO: 24417 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaagattcagagactttatggtttggctactgttgctaa

SEQ ID NO: 24418 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaaggttcagagactttatggtttggctactgttgctaa

SEQ ID NO: 24419 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 24420 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24421 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24422 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 24423 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcaacaagatggaaaggttcagagactttatggtttggctactgttgctaa

SEQ ID NO: 24424 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 24425 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggctacgttgctaa

SEQ ID NO: 24426 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctaagctaccaacatctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 24427 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgattctcagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24428 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24429 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24430 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattacttctcagctaccaacaaccctgatgcaccagttatgttggaccgaatgttgcgtcacttggcttgttacaatatcctcacttgttcagttcgtactcaacaagatggaaagattcagagactttatggtttggctactgttgctaa

SEQ ID NO: 24431 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24432 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24433 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24434 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24435 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24436 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagattgaaacgttcagagactttatggtttggctactgttgctaa

SEQ ID NO: 24437 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24438 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaactgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24439 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24440 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaagattcagagactttatggtttggctactgttgctaa

SEQ ID NO: 24441 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagactttatggtttggctactgttgctaa

SEQ ID NO: 24442 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctatcgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24443 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctagtgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24444 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctaatgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24445 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggctactgttgctaa

SEQ ID NO: 24446 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaaagttcagagactttatggtttggctactgttgctaa

SEQ ID NO: 24447 - DNA, 320 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaagattcagagcctttatggtttggctactgtgctaa

SEQ ID NO: 24448 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacatattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24449 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaattgcacctattgaaattgcttctcagctcccaacaactatgccggtgctgtgccaggcccacggcttgaccccggagcaggtggtggccatcgccagccacgatggcggcaagcactgatgcaccagttatgttggaccgaatgttgcgtctcttggcttgttacaatatcctcacttgttcagttcgtactcaacaagatggaaagattcagagactttatggtttgctactgttgctaa

SEQ ID NO: 24450 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatctcacctattgaaattgcttctcagctaccaacaaccatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24451 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaacttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24452 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcgcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24453 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcgcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24454 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcccaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24455 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcccaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24456 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcccaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24457 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 24458 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 24459 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgcaacagttatgttggaccgaatgttgcgtctcttggcttgttacattatcctcacttgttcagttcgtactcaacaagatggaaagattcagagactttatggtttggctactgtagctaa

SEQ ID NO: 24460 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24461 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24462 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24463 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgatcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24464 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgatcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24465 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtcctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24466 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtactcaaatttcacctattgaaattgcttctcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24467 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24468 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 24469 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactttatggtttagctactgttgctaa

SEQ ID NO: 24470 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactatatggtttggctactgttgctaa

SEQ ID NO: 24471 - DNA, 290 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactttatggtttggcttactgttgctaa

SEQ ID NO: 24472 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaagattcagagactttatggtttggctactgttgctaa

SEQ ID NO: 24473 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacccggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 24474 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaactggtgctcaaatttcacagattgaaattgcttatcagctcctaacaacgatgctccagttatgttggaccgaatgttgcgtctcttggcttgttacaatatcctcacttgttcagttcgtactcaacaagatggaaagattcagagactttatggtttggctactgtttctaa

SEQ ID NO: 24475 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24476 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaagttcagagactttatggtttggctactgttgctaa

SEQ ID NO: 24477 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 24478 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaagattcagagactttatggtttggctactgttgctaa

SEQ ID NO: 24479 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctagacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 24480 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctagacctggtgctcaaatttcacctattgaaattgcttctcagctaccactgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 24481 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctagacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24482 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagatggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24483 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagatggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24484 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgataaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24485 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattcctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24486 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattcctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24487 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattactaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24488 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactgctaaagctggacctggtgctcaaatttcacctattgaaattgcttctcagctaccaacaatctgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 24489 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24490 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24491 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaccattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24492 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttacaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24493 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcatagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24494 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctattagaaatcattgctaaagctggacctggtactcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24495 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctacaagatggaaagattcagagactttatggtttggctactgttgctaa

SEQ ID NO: 24496 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatatcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24497 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttaatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24498 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttaatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24499 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactggatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24500 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactagatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24501 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacgtgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24502 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24503 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaagttcagagactttatggtttggctactgttgctaa

SEQ ID NO: 24504 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24505 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctcgaacttgatctcttagaaatcattgctaaagctggacctggtgctcaaatttcacctattgaaattgcttctcagctcccaacaactaaggcgcagcggtcgggctgaacggggggttaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24506 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctatgttggaccgaatgttgcgtctcttggcttgttacaatatcctcacttgttctgttcgtactcaacaagatggaaaggttcagagactttatggtttggctactgttgctaa

SEQ ID NO: 24507 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 24508 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctatgttggaccgaatgttgcgtctcttggcttgttacaatatcctcacttgttcagttcgtactcaacaagatggaaagattcagagactttatggtttggctactgttgctaa

SEQ ID NO: 24509 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctatgttggaccgaatgttgcgtctcttggcttgttacaatatcctcacttgttcagttcgtactcaacaagatggaaagattcagagactttatggttaggctactgttgctaa

SEQ ID NO: 24510 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctatgttggaccgaatgttgcgtctcttggcttgttacaatatcctcacttgttcagttcgtactcaacaagatggaaaagttcagagactttatggtttggctactgttgctaa

SEQ ID NO: 24511 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctagaacttgatctcttagaaatcattgctaaagctggacctggtgctcaaatttcacctattgaaattgcttctcagctaccaacaatgatgcaccagttatgttggcccgaatgttgcgtctcttggattgttacaatatccgcacttgttcagttcgtgctcaacgagatggaaaagttcagagcctttatggacaggctaccggtgctaa

SEQ ID NO: 24512 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcctgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24513 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcctgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24514 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctattgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24515 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaataagctcttgaacttgatctcttagaaatcattgctaaagctggacctggtgctcaaatttcacctattgaaattgcttctcagctcccaacctgatgcaccagttatgttgtaccgaatgttgcgtctcttgtcttgttacaatatcctcacttgttcagttcttactcaacaaaatttaaatgttcagagactttatggtttagctactgttgctaa

SEQ ID NO: 24516 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaataagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaagattcagagactttatggtttggctactgttgctaa

SEQ ID NO: 24517 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaataagctcttgaacttgatctcttagaaatcattgctaaagctggacctggtgctcaaatttcacctattgaaattgcttctcaactcccaacaatgcaccagttatctttgaccgaatatttcatctcttgacttgttacaatatcctcacttcttcacttcctactcaacaatattcaaagcttcagagactttattgtttatctactgttcctaa

SEQ ID NO: 24518 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaaccagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24519 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcgcttgttctgttcgtactcaacaagatggaaaggttcagagactttatggtttggctactgttgctaa

SEQ ID NO: 24520 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttctgttcgtactcaacaagatggaaaggttcagagactttatggtttggctactgtttctaa

SEQ ID NO: 24521 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttctgttcgtactcaacaagatggaaaggttcagagactttatggtttggctactgttgctaa

SEQ ID NO: 24522 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttctgttcgtactcaacaagatggaaagattcagagactttatggtttggctactgttgctaa

SEQ ID NO: 24523 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcgacaagatggaaaggttcagagactttatggtttggctactgttgctaa

SEQ ID NO: 24524 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggataggttcagagactttatggtttggctactgttgctaa

SEQ ID NO: 24525 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctacttttgctaa

SEQ ID NO: 24526 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 24527 - DNA, 247 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaagattcagagactttatggtttggctatgttgctaa

SEQ ID NO: 24528 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaagattcagagactttatggtttggctactgttgctaa

SEQ ID NO: 24529 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaagttcagagactttatggtttggctactgttgctaa

SEQ ID NO: 24530 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttagaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaaggttcagagactttatggtttggctactgttgctaa

SEQ ID NO: 24531 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttagaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24532 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttagaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24533 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaatcagctcttgaacttgatctcttagaaatcattgctaaagctggacctggtgctcaaatttcacctattgaaattgcttctcagctaccaacaactaaccagaccaggaacaagcacatcaaccccaacgagtggtggaaggtgtacccctccagcgtgaccgagttcaagttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24534 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaagatcagctcttgaactttatctcttagaaatcattgctaaagctggaccgaatgttgcgtctctcggcttgttacaatatcctcacttgttcagttcgtactcaacaagatggaaaggttcagagactttatggtttggctactgttgctaa

SEQ ID NO: 24535 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaagatcagctcttgaacttgatctcttagaaatcattgctaaagctggacctggtgctcaaatttcacctgttcaaattgcttctcagcttccaacatgcaccactcatgttggaccgaatgttgcgtctcttggcttgttacaatatcctcacttgttctgttcgtactcaacaagatggaaaggttcagagactttatggtttggctactgttgctaac

SEQ ID NO: 24536 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaagatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaaggttcagagactttatggtttggctactgttgctaa

SEQ ID NO: 24537 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaacatcagctcttgaacttgatctcttagaaatcattgctaaagctggacctggtgctcaaatttcacctattgaaattgcttctcagctcccaacagctgatgcaccagttatgttggaccgaatgttgcgtctcttggcttgttacaatatcctcacttgttcagtccgtactcaacaagatggaaaggttcagagactttatggtttggctactgtaactaa

SEQ ID NO: 24538 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaattcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24539 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaattcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24540 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaattcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24541 - DNA, 234 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgacttgttacaatatcctcacttgttcagttcgtactcaacaagatggaaaggttcagagactttatggtttggctactgttgctaa

SEQ ID NO: 24542 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 24543 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgaacttgatctcttagaaatcattgctaaagctggacctggtgctcaaatttcacctattgaaattgcttctcagctcccaacaacctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 24544 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24545 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaactcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24546 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaattagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24547 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 24548 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatgggaagattcagagactttatggtttggctactgttgctaa

SEQ ID NO: 24549 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24550 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24551 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaatcattgctaaagctggacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24552 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaattttacctgttcaaattgcttctcagcttccaacaacttgatgcaccagtcatgttggactgaatgttgcgtctcttggcttgttacaatatcctcccttgttctgttcgtaatgaacaagatggaaaggttcagagattttatggtttggctaccgttgctaa

SEQ ID NO: 24553 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24554 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24555 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagttcttgaacttgatctcttagaaatcattgctaaagctggacctggtgctcaaatttcacctattgaaattgcttctcagctcccaacaatgcaccagttatgttggaccgaatgttgcgtttcttggcttgttacaatatcctcacttgttcagttcgtactcaacaagatggaaaggttcagagactttatggtttggctactgttgctaa

SEQ ID NO: 24556 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcttttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24557 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctttaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24558 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgtcttgttacaatatcctcacttgttcagttcgtactcaacaagatggaaaggttcagagactttatggtttggctactgttgctaa

SEQ ID NO: 24559 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgtacttgatctcttagaaatcattgctatagctggacctgttgctcaaatttcacctattgaaattgcttctcagctcccaacaactgatgcaccagttatgttggaccgaatgtggcgtctcttggcttgttacaatatcctcacttgttcagttcgtactcaacaagatggaaaggttcagagactttatgggttggctactgttgcgaa

SEQ ID NO: 24560 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggcttgttacaatatcctcacttgttcagttcgtactcaacaagatggaaagattcagagactttatggtttggctactgttgctaa

SEQ ID NO: 24561 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggcttgttacaatatcctcacttgttcagttcgtactcaacaagatggaaaagttcagagactttatggtttggctactgttgctaa

SEQ ID NO: 24562 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24563 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgcacttgatctcttagaaatcattgctaaagctggacctggtgctcaaatttcacctattgaaattgcttctcagctcccaacaagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24564 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagcctttatggtttggctactgttgctaa

SEQ ID NO: 24565 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24566 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24567 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24568 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24569 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24570 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttctgttcgtactcaacaagatggaaaggttcagagactttatggtttggctactgttgctaa

SEQ ID NO: 24571 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcagcaagatggaaagattcagagactttatggtttggctactgttgctaa

SEQ ID NO: 24572 - DNA, 234 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaaggttcagagactttatggtttggtactgttgctaa

SEQ ID NO: 24573 - DNA, 234 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaaggttcagagactttatggtttggctactttgctaa

SEQ ID NO: 24574 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaaggttcagagactttatggtttggctactgttgctaa

SEQ ID NO: 24575 - DNA, 234 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaaggttcagagactttatggtttggctactgttgcaa

SEQ ID NO: 24576 - DNA, 236 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaagattcagagactttatggtttggctactgttgctaac

SEQ ID NO: 24577 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 24578 - DNA, 234 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaagattcagagactttatggtttggctactgttctaa

SEQ ID NO: 24579 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaaagttcagagactttatggtttggctactgttgctaa

SEQ ID NO: 24580 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaccttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24581 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24582 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactttatctcttagaaatcattgctaaagctggacctggtgctcaaatttcacctattgaaattgcttctcagctcccaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24583 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactttatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24584 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgttctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24585 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgttctacaagatggaaagattcagagactttatggtttggctactgttgctaa

SEQ ID NO: 24586 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttagaaatcattgctaaagctggacctggtgctcaaatttcactgtcaccgaatgttgcgtctcttggcttgttacaatatcctcacttgttctgttcgtactcaacaagatggaaaggttcagagactttatggtttggctactgttgctaa

SEQ ID NO: 24587 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttagaaatcattgctaaagctggacctggtgctcaaatttcacctattgaaattgttacaatatcctcacttgttcagttcgtactcaacaagatggaaaggttcagagactttatggtttggctactgttgctaa

SEQ ID NO: 24588 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24589 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24590 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24591 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatttcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24592 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 24593 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctgttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24594 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 24595 - DNA, 266 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctggaccgaatgttgcgtctcttggcttgttacaatatcctcacttgttcagttcgtactcaacaagatggaaagattcagagactttattgtttggctactgttgcta

SEQ ID NO: 24596 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctggaccgaatgttgcgtctcttggcttgttacaatatcctcacttgttcagttcgtactcaacaagatggaaagattcagagactttatggtttggctactgttgctaa

SEQ ID NO: 24597 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctggaccgaatgttgcgtctcttggcttgttacaatatcctcacttgttcagttcgtactcaacaagatggaaagattcagagactttatggtttggctactgttactaa

SEQ ID NO: 24598 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctggaccgaatgttgcgtctcttggcttgttacaatatcctcacttgttcagttcgtactcaacaagatggaaaagttcagagactttatggtttggctactgttgctaa

SEQ ID NO: 24599 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctttgaaatcattgctaaagctggacctggtgctcaaatttcacctattgaaattgcttctcagctaccaacaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 24600 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggcttgttacaatatcctcacttgttcagttcgtactcaacaagatggaaaggttcagagactttatggtttggctactgttgctaa

SEQ ID NO: 24601 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggcttgttacaatatcctcacttgttcagttcgtactcaacaagatggaaagattcagagactttatggtttggctactgttgctaa

SEQ ID NO: 24602 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggcttgttacaatatcctcacttgttcagttcgtactcaacaagatggaaaagttcagagactttatggtttggctactgttgctaa

SEQ ID NO: 24603 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaatcattgctaaagctggacctggtgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24604 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24605 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaatcattgctaaagctggacctggtgctcaaatttcacctgttcaaattgcttctcagctttcaacatcctgatgcaacagtcatgttggaccgaatgttgcgtctctttgcttgttacaatgtcctcacttgttctgtgcttactcaacaagatggaatggttcagagactttatggtttggctactgttgctaa

SEQ ID NO: 24606 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24607 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaatcattgctaaagctcgacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24608 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggaatcattgctaaagctggacctggtgctcaaatttcacctattgaaattgcttctcagctcccaatgcaccagttatgttggaccgaatgttgcgtcgcttggcttgttacaatatcctcacttgttcagttcgtactcaacaagatggaaagtttcagagactttatggtttggctactgttgctaa

SEQ ID NO: 24609 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgtctaa

SEQ ID NO: 24610 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24611 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24612 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24613 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24614 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24615 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24616 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24617 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttctaaagctggacctggtgctcaaatttcacctgttcaaattgcttctcttggcttgttacaatatcctcacttgttctgttcgtactcaacaagatggaaaggttcagagactttatggtttggctactgttgctaa

SEQ ID NO: 24618 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24619 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24620 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgttaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaagattcagagactttatggtttggctactgttgctaa

SEQ ID NO: 24621 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgttaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24622 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcttaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24623 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcttaagctggacctggtgctcaaatttcacctattgaaattgcttctcagctaccaacaccagttatgctggaccgaatgttgcgtctcttggcttgttacaatatcctcacttgttcagttcgtactcaacaagatggaaaagttcagagactttatggtttggctactgttgctaa

SEQ ID NO: 24624 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctgaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24625 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctatagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24626 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctatagctggacctagtgcgcaaagttcacctattgaaattgcttctcagcacccaacgatgccccagttatgttggaacgaatgttgcggctcttggcttgttacaatatcctcacttgttcagttcgtactcaacaagatggaaaagtacagagactttatggtttggctactgttgataa

SEQ ID NO: 24627 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24628 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24629 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24630 - DNA, 301 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaatatgcaccagttatgttggaccgaatgttgcgtctcttggcttgttacaatatcctcacttgttcagttcgtactcaacaagatggaaaggttcagagactttatggtttggctctgttgctaa

SEQ ID NO: 24631 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaatatgcaccagttatgttggaccgaatgttgcgtctcttggcttgttacaacatcctcacttgttcagttcgtactcaacaagatggaaaagttcagagactttatggtttggcgactggtgctaa

SEQ ID NO: 24632 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaggctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24633 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctcagcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24634 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaatctggacctggtgctcaaatttcacctgttcaaattgcttctcagcttccaacaactaccagtcatgttggaccgaatgttgcgtctcttggcttgttacaatatcctcacttgttctgttcgtactcaacaagatggaaaggttcagagactttatggtttggctactgttgctaa

SEQ ID NO: 24635 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaatctggacctggtgctcaaatttcacctattgaaattgcttctcagctaccaatgatgcaccagttatgttggaccgaatgttgcctctcttggcttgttacaatatcctcacttgttcagttcgtactcaacaagatgcaaaagttcagaacctttatggtttggctactgttgctaa

SEQ ID NO: 24636 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaatctggacctggtgctcaaatttcacctattgaaattgcttctcagctaccaacaactgatgcaccagttatgttggaccgaatgttgcgtctcttggcttgttcaatatcctcacttgttcagttcgtactcaacaagatggaaaggttcagagactttatggtttggctactgttgctaa

SEQ ID NO: 24637 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24638 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctcccaacaacctgatgcaccagttatgttggaccgaatgttgcgtctcttggcttgttacaatatcctaacttgttcagttcgtactcaacaagatggaaagattaagagactttatggtttggctactgttgctaa

SEQ ID NO: 24639 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24640 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24641 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggacctggagctcaaatttcacctattgaaattgcttctcagctcccaacatcctgatgcaccagttatgttggagcggatgttgcgtctatgggcttgttttaatatcctcactagttcagttcgtactcaacaagatgggaaggttcagagtctttatggtttgcctactggtgctaa

SEQ ID NO: 24642 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggaccgaatgttgcgtctcttggcttgttacaatatcctcacttgttctgttcgtactcaacaagatggaaaggttcagagactttatggtttggctactgttgctaa

SEQ ID NO: 24643 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaaggttcagagactttatggtttggctactgttgctaa

SEQ ID NO: 24644 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaaggttcagagactttatagtttggctactgttgctaa

SEQ ID NO: 24645 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaagattcagagactttatggtttggctactgttgctaa

SEQ ID NO: 24646 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaaagttcagagactttatggtttggctactgttgctaa

SEQ ID NO: 24647 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagcttgacctggtgctccaatttcacctattgaaattgcttctcagctcccaacaagatgcaccagttatgttcaaccgaattttgcgtatctttgcttgttacaacgtcctcacttgttcagttcgtactcaactagattcaatgaatcacagaaattattgtttggctactgttactaa

SEQ ID NO: 24648 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagcttgacctggtgctcaaatttcacctattgaaattgcttctcagctcccaacagatttaccagttatgttggaccgaatgttgcgtctcttggcttgttacaatatcctcacttgttcagttcgtactcaacaagatggaaagattcagagactttatggtttggctactgttgctaa

SEQ ID NO: 24649 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagcttgacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24650 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagcttgacctggtgctcaaatttcacctattgaaattgcttcgcagctcccaacaacctgatgcaccagttatgttgtactgaatgtggcgcctcttggcttgttacaatatcctcacttgttcagttcgtactcaacaagatggaaaggttcagagactttatggtttggctactgttgctaa

SEQ ID NO: 24651 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagcttgacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24652 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgttcaaatttcgcctattgaaattgcttctcagctaccaacactgattcaccagttatgttgaaccgaatgttgcgtctcttggcttgttacaatatcctcacttgttcagttcgtactcaacaagatggaaaggttcagagcctttatggtttggctactgttgctaa

SEQ ID NO: 24653 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgacattgcttctaagctcccaacaacttggcaagcaggcgctggcgactgtccagcggctgatgccggtgctgtgccaggcccacggcgtgaccccggagccggtggtggccatcgccagccacgacggcggcaagcaggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24654 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccgacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24655 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 24656 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaactgatgcaccagttatgttgtaccgaatgttgcgtctcttggcttgttacaatatcctcacttgttcagttcgtactcaacaagatggaaagattcagagactttatggtttggctactgttgctaa

SEQ ID NO: 24657 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaactgatgcaccagttatgttggaccgaatgttgcgtctcttggcttgttacaatattctcacttgttcagttcgtactcaacaagatggaaaagttcagagactttatggtttggctactgttgctaa

SEQ ID NO: 24658 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaacgatgctccagttatgttggaccgaatgttgcgtctcttggcttgttacaatatcctcacttgttcagttcgtactcaacaagatggaaagattcagagactttatggtttggctactgttctaa

SEQ ID NO: 24659 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24660 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24661 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggtcctggtgctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24662 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggtcctggtgctcaaatttcacctattgagattgcttctcagctccctacctgattcaccagtcatgttggaccgaatgttgcatctcttggcttgttacaatatcctcacttgttcagttcgtactcaataagatggaaaggttcagagactttatggtttggcgactgttgctaa

SEQ ID NO: 24663 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggtcctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24664 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 24665 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24666 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24667 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24668 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24669 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24670 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctaccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24671 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggatctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24672 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggatctggtgctcaaatttcacctattgaaattgcctctcagctcccaacaacctgatgcaccagttatgttcgaccgaatgttgcgtctcttggcttgttacaatatcctcacttgttcagttcgtactcaacaagatggaaaggttcagagactttatggtttggctactgttgctaa

SEQ ID NO: 24673 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggagctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24674 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24675 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24676 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24677 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctcccaacatgttggaccgaatgttgcgtctcttggtttgttacaatatcctcacttgttcagttcgtactcaacaagatggaaagattcagagactttatggtttggctactgttgctaa

SEQ ID NO: 24678 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24679 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24680 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24681 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24682 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcgcctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24683 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcatctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24684 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcacctgttcaaattgcttctcagcttccaacaacgtactcaacaagatggaaaggttcagagactttatggtttggctactgttgctaa

SEQ ID NO: 24685 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcacctattgaaattgtttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24686 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctgttcaaattgcttctcagcttccaacaactaccctgctgcaccagtcatgttggaccgaatgttgcgtctcttggcttgttacaatatcctcacttgttctgttcgtactcaacaagatggaaaggttcagagactttatggtttggctacgttgctaa

SEQ ID NO: 24687 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctgttcaaattgcttctcagctgatgcaccagtcatgttggaccgaatgctgcgtctcttggcttgttacaatatcctcacttgttctgttcgtactcaacaagatggaaaggttcagagactttatggtttggctactgttgctaa

SEQ ID NO: 24688 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctgttcaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24689 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctattgaaattgcttctcagctcccaacaagcaccagttatgttggaccgaatgttgcgtctcttggcttgttacaatttcctcacttgttcagttcgtactcaacaagatggaaagattcagagactttatggtttggctactgttgctaa

SEQ ID NO: 24690 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24691 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggttctcaaatttcacctattgaaattgcttctcagctcccaacaacgcagtggaggcagtgcatgcatggcggaatgcactgagcggggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24692 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggttctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24693 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggttctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24694 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgttcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24695 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgttcaaatttcacctattgaaattgcttctcagctcccaacaactacatacgtcagaaaccattattgcgcgttcaaaagtcgcctaaggtcactatcagctagcaaatatttcttgtcaaaaatgctccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24696 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgttcaaatttcacctattgaaattgcttctcagctcccaacaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24697 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24698 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24699 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcttaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24700 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcttaaatttcacctattgaaattgcttctcagctaccaacgaccgaatgttgcgtctcttggcttgttacaatatcctcacttgttcagttcgtactcaacaagatggaaaggttcagagactttatggtttggctactgttgctaa

SEQ ID NO: 24701 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcttaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24702 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcttaaatttcacctattgaaattgcttctcagctaccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 24703 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctctaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24704 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctctaatttcacctattgaaattgcttctcagctcccaacaactaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24705 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcgaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24706 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcgaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctctgttgctaa

SEQ ID NO: 24707 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcgaatttcacctattgaaattgcttctcaacaagatggaaaagttcagagactttatggtttggctactgttgctaa

SEQ ID NO: 24708 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 24709 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24710 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24711 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24712 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcagatttcacctgttcaaattgcttctcagcttccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24713 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcagatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24714 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 24715 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaagattcagagactttatggtttggctactgttgctaa

SEQ ID NO: 24716 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggcttggctactgtgctaa

SEQ ID NO: 24717 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcacatttcacctattgaaattgcttctcagctcccaagttatgttggaccgaatgttgcgtctcttggcttgttacaatatcctcacttgttcagttcgtactcaacaagatggaaagattcagagactttatggtttggctactgttgctaa

SEQ ID NO: 24718 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaggttcagagactttatggtttggctactgttgctaa

SEQ ID NO: 24719 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaatatgttggaccgaatgttgcgtctcttggcttgttacaatatcctcacttgttcagttcgtactcaacaagatggaaagattcagagactttatggtttggctactgttgctaa

SEQ ID NO: 24720 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaagttcagagactttatggtttggctactgttgctaa

SEQ ID NO: 24721 - DNA, 311 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaggttcagagactttatggtttggctactgttgcctaa

SEQ ID NO: 24722 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaagtttcacctattgaaattgcttctcagctcccaacaactaccagttatgttggaccgaatgttgcgtctcttggcttgttacaatatcctcacttgttcagttcgtactcaacaagatggaaaagttcagagactttatggtttggctactgttgctaa

SEQ ID NO: 24723 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaactttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24724 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattttacctattgaaattgcttctcagctaccaacaacttatcttcgagccagccacgatcgacattgatctgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24725 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24726 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactgatgcaccagttatgttggaccgaatgttgcgtctcttggcttgttacaatatcctcccttgttcagttcgtactcaacaagatggaaagattcagagactttatggtttggctactgttgctaa

SEQ ID NO: 24727 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24728 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24729 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactaccagttatgttggaacgaatgttgcgtcgcttggctggttacaatatcctcacttgttcagttcgtactcaacaagatggaaagattcagagactttatggtttggctactgttgctaa

SEQ ID NO: 24730 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24731 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24732 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24733 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24734 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 24735 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctacaaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24736 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcatctcagatcccaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24737 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctatttaaattgcttcgcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 24738 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcggctcccaacaactaaccacgatggcggcaagcaggcgctggagactgatgcaccagttatgttggaccgaatgttgcgtctcttggcttgttacaatatcctcacttgttcagttcgtactcaacaagatggaaaggttcagagactttatggtttggctactgatgctaa

SEQ ID NO: 24739 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcatctcccaacaacatgcaccagttatgttggaccgaatgttgcgtctcttggcttgttacaatatcctcacttgttcagttcgtactcaacaagatggaaagattcagagactttatggtttggctactggtgcgaa

SEQ ID NO: 24740 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24741 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaactgatgcaccagttatgttggaccgaatgttgcgtctcttggcttgttacaatatcctcacttgttcagttcgtactcaacaagatggaaagattcagagactctatggtttggctactgttgctaa

SEQ ID NO: 24742 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24743 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24744 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24745 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24746 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24747 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 24748 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactgatgcaccagttatgttagaccgaatgttgcgtcacttggcttgttacaatatcctcacttgttcagttcgtactcaacaagatggaaaggttcagagactttatggtttggctactgtagataa

SEQ ID NO: 24749 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactaccctgatgcaccagttatgtgagaccgaatgttgcgtctcttggcttgttacaatatcctcacttgttcagttcgtactcaacaagatggaaaggttcagagactttatggtttggctactgttgctaa

SEQ ID NO: 24750 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24751 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctaccaatatgcaccagttatgttggaccgaatgttgcgtctcttggctggttacaatatcctcacttgttctgttcgtactcaacaagatggaaaggttcagagactttatggtttggctactgttgctaa

SEQ ID NO: 24752 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24753 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctaccaacaactgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 24754 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagaccgaatgttgcgtctcttggcttgttacaatatcctcactttttcagttcgtactcaacaagatggaaaggttcagagactttatggtttggctactgttgctaa

SEQ ID NO: 24755 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcccctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24756 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcccctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgtttctaa

SEQ ID NO: 24757 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24758 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24759 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctcccaacaactacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24760 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24761 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctaccaacagttatgttggaccgaatgttgcgtctcttggcttgttacaatatcctcacttgttcagttcgtactcaacaagatggaaaggttcagagactttatggtttggctactgttgctaa

SEQ ID NO: 24762 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctaccaacaacttgcaccagttatgttggaccgaatgttgcgtctcttggcttgttacaatatcctcacttgttcagttcgtactcaacaagatggaaagattcagagactttatggtttggctactgttgctaa

SEQ ID NO: 24763 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcagctattgactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24764 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacttattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24765 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacttattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24766 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgtcaccgaatgttgcgtctcttggcttgttacaatatcctcacttgttctgttcgtactcaacaagatggaaagattcagagactttatggtttggctactgttgctaa

SEQ ID NO: 24767 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgtcaccgaatgttgcgtctcttggcttgttacaatatcctcacttgttctgttcgtactcaacaagatggaaaggttcagagactttatggtttggctactgttgctaa

SEQ ID NO: 24768 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgtcaccgaatgttgcgtctcttggcttgttacaatatcctcacttgttctgttcgtactcaacaagatggaaaggttcagagcctttatggtttggctactgttgctaa

SEQ ID NO: 24769 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgtcaccgaatgttgcgtctcttggcttgttacaatatcctcacttgttcagttcgtactcaacaagatggaaagattcagagactttatggtttggctactgttgctaa

SEQ ID NO: 24770 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgtcaccgaatgttgcgtctcttggcttgttacaatatcctcacttgttcagttcgtactcaacaagatggaaaggttcagagactttatggtttggctactgttgctaa

SEQ ID NO: 24771 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24772 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24773 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24774 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccttttgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24775 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccttttcaaattgcttctcagctcccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24776 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttgaaattgcttctcagctcccaacaactagcgcctgcttgccgccatcggggcgggcgctggccacccccggccccggggtcaagccgtgggcctggcagagcaccggcaacagccgctggaccgtctccagcgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24777 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24778 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24779 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcagattacttctcagcttccaacaacctgatgcaccagtcatgttggactgaatgttgcgtctcgtggcttgttacaatatcctcacttgttctgttcgtactcaacaagatggaaaggttcagagactttatggtttggctactgttgctaa

SEQ ID NO: 24780 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcttggcttgttacaatatcctcacttgttctgttcgtactcaacaagatggaaaggttcagagactttatggtttggctactgttgctaa

SEQ ID NO: 24781 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcttggcttgttacaatatcctcacttgttcagttcgtactcaacaagatggaaagattcagagactttatggtttggctactgttgctaa

SEQ ID NO: 24782 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcttggcttgttacaatatcctcacttgttcagttcgtactcaacaagatggaaaggttcagagactttatggtttggctactgttgctaa

SEQ ID NO: 24783 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcggcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24784 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctttgttggaccgaatgttgcgtctcttggcttgttacaatatcctcacttgttcagttcgtactcaacaagatggaaagattcagagactttatggtttggctactgttgctaa

SEQ ID NO: 24785 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctttgttggaccgaatgttgcgtctcttggcttgttacaatatcctcacttgttctgttcgtactcaacaagatggaaaggttcagagactttatggtttggctactgttgctaa

SEQ ID NO: 24786 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctttgttggaccgaatgttgcgtctcttggcttgttacaatatcctcacttgttcagttcgtactcaacaagatggaaaggttcagagactttatggtttggctactgttgctaa

SEQ ID NO: 24787 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttgcaccagttatgttggaccgaatgttgcgtctcttggcttgttacaatatcctcacttgttcagttcgtactcaacaagatggaaagattcagagactttatggtttggctactgttgctaa

SEQ ID NO: 24788 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24789 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccagcaactaggcgctggagacggtgcaggcgctgttgccggtgctgtgccaggcccacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24790 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24791 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24792 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24793 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24794 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24795 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24796 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatccttacttgttctgttcgtactcaacaagatggaaaggttcagagcctttatggtttggctactgttgctaa

SEQ ID NO: 24797 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24798 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24799 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagttatgttggaccgaatgttgcgtctcttggcttgttacaataccctcacttgttcagttcgtactcaacaagatggaaaggttcagagactttatggtttggctactgttgctaa

SEQ ID NO: 24800 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24801 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24802 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24803 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatattggaccgaatgttgcgtcacttggcttgttgcaatatcctcacttgttctgttcgtactcaacaagatggaaaggttcagagactttatggtttggctactgttgctaa

SEQ ID NO: 24804 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24805 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24806 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24807 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24808 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24809 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24810 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtcttttggcttgttacaatatcctcacttgttcagttcgtactcaacaagatggaaaggttcagagactttatggtttggctactgttgctaa

SEQ ID NO: 24811 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24812 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24813 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 24814 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24815 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 24816 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24817 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24818 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24819 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24820 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24821 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24822 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24823 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24824 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 24825 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24826 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24827 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgtttgaccgaatgttgcgtctcttggcttgttacaatatcctcacttgttctgttcgtactcaacaagatggaaaggttcagagactttatggtttggctactgttgctaa

SEQ ID NO: 24828 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24829 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24830 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24831 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaatgttcagagactttatggtttggctactgttgctaa

SEQ ID NO: 24832 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggctcgttacaatatcctcacttgttctgttcgtactcaacaagatggaaaggttcagagactttatggtttggctactgttgctaa

SEQ ID NO: 24833 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgtggctaa

SEQ ID NO: 24834 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaagattcagagcctttatggtttggctactgttgctaa

SEQ ID NO: 24835 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24836 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagtcatgttggaccgaattttgcctctcttggctttttaaaataatctcccttgttcagttcgtactcaaccagatggaaaagttcagagactttatggtttggctactgttgctaa

SEQ ID NO: 24837 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24838 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24839 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaccgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24840 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24841 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24842 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagttatgttggaccgaatgtttcgtctcttggcttgttacaatatcctcacttgttcagttcgtactaaccaagacggaaaggttcagagactttatggtttggctactgttgctaa

SEQ ID NO: 24843 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 24844 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24845 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24846 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24847 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttgacttgttacaatatcctcacttgttcagttcgtactcaacaagatggaaagattcagagactttatggtttggctactgttgctaa

SEQ ID NO: 24848 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttgacttgttacaatatcctcacttgttctgttcgtactcaacaagatggaaaggttcagagactttatggtttggctactgttgctaa

SEQ ID NO: 24849 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24850 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24851 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttgtaccgaatgttgcgtctcttggcttgttacaatatcctcacttgttctgttcgtactcaacaagatggaaaggttcagagactttatggtttggctactgttgctaa

SEQ ID NO: 24852 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24853 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24854 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttccgttcgtactcaacaagatggaaaggttcagagactttatggtttggctactgttgctaa

SEQ ID NO: 24855 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24856 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24857 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacttatcccctgattctgtggataaccgtattaccgcctttgagtgagccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24858 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacttatcccctgattctgtggataaccgtattaccgcctttgagtgagccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24859 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacttatcccctgattctgtggataaccgtattaccgcctttgagtgagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24860 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24861 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24862 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24863 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24864 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24865 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttcagttcgtactcaacaagatggaaaggttcagagactttatggttgggctactgttgctaa

SEQ ID NO: 24866 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24867 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24868 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgcta

SEQ ID NO: 24869 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24870 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24871 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactcgtaaccgttgcgatatgctctcaaccggcattaaaagcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24872 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24873 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24874 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttcagttcgtgctcaacaagatggaaagattcagagactttatggtttggctactgttgctaa

SEQ ID NO: 24875 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24876 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24877 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttcagttcgtactcaacaagatggaaagattcagagactttaaggtttggctactgttgctaa

SEQ ID NO: 24878 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactacttgaccccggagcaggtggtggccatcgccagccacgatggcggcaacagccgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24879 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24880 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24881 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24882 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24883 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24884 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24885 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaaagttcagagactttatggtttggctactgtcgctaa

SEQ ID NO: 24886 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtacgcaacaagatggaaaggttcagagactttatggtttggctactgttgctaa

SEQ ID NO: 24887 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccagttatgttggaccgaatgttgcgtctcttggcttgttacaatatcctcacttgttcagttcgtactcaacaagatggaaagattcagagactttatggtttggctactgttgctaa

SEQ ID NO: 24888 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaaggttcagagactttatggtttggctactgttgctaa

SEQ ID NO: 24889 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaaagttcagagactttatggtttggctactgttgctaa

SEQ ID NO: 24890 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaagattcagagactttatggtttggctactgttgctaa

SEQ ID NO: 24891 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttctgttcgtactcaacaagatggaaaggttcagagactttatggtttggctactgttgctaa

SEQ ID NO: 24892 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24893 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24894 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttctgttcgtactcaacaagatggaaaggttcagagactttatggtttggctactgctaa

SEQ ID NO: 24895 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttcagttcgtactcaacaagatggaaaggttcagagactttatggtttggctactgttgcgaa

SEQ ID NO: 24896 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 24897 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24898 - DNA, 459 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacggtccagcggctgttgccggtgctgtgccaggcccacggcttgaccccggagcaggtggtggccatcgccagccacgatggcggcaagcaggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24899 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24900 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24901 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24902 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24903 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24904 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24905 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 24906 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacgtacccaacaagatggaaaggttcagagactttatggtttggctactgttgctaa

SEQ ID NO: 24907 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24908 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24909 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24910 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24911 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24912 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 24913 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24914 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24915 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtcctcaacaagatggaaaggttcagagcctttatggtttggctactgttgctaa

SEQ ID NO: 24916 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 24917 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcatctcttggcttgttacaatatcctcacttgttctgttcgtactcaacaagatggaaaggttcagagactttatggtttggctactgttgctaa

SEQ ID NO: 24918 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 24919 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24920 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaagttcagagactttatggtttggctatgttgctaa

SEQ ID NO: 24921 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcactttttctgttcgtactcaacaagatggaaaggttcagagactttatggtttggctactgttgctaa

SEQ ID NO: 24922 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24923 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24924 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24925 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttctgttcgtactcaacaagatggaaaggttcagagactttatggtttggctactgttgctaa

SEQ ID NO: 24926 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttcagttcgtactcaacaagatggaaaggttcagagactttatggtttggctactgttgctaa

SEQ ID NO: 24927 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttcagttcgtactcaacaagatggaaagattcagagactttatggtttggctactgttgctaa

SEQ ID NO: 24928 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctctcttgttcagttcgtactcaacaagatggaaagattcagagactttatggtttggctactgttgctaa

SEQ ID NO: 24929 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttctgttcgtactcaacaagatggaaagattcagagactttatggtttggctactgttgctaa

SEQ ID NO: 24930 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaccagatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24931 - DNA, 402 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacagcggctgttgccggtgctgtgccaggcccacggcttaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24932 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacacggatggcctttttgcgtttctacaaactcttcctggctagcggtacgcgtattaattgctttgctctcactgcccgctttccagtcgggaaacctgtcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24933 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24934 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtacccaacaagatggaaaggttcagagactttatggtttggctactgttgctaa

SEQ ID NO: 24935 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24936 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttctaa

SEQ ID NO: 24937 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24938 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaacagtcatgttgtaccgaatttttcgtctcttggcttgttacaatatcctcacttgttctgttcgtactcaacaagatggaaaggttcagagcctttatggtttggctactgttgctaa

SEQ ID NO: 24939 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 24940 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24941 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 24942 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacagtatcctcacttgttcagttcgtactcaacaagatggaaaggttcagagactttatggtttggctactgttgctaa

SEQ ID NO: 24943 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 24944 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24945 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24946 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24947 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacttatgttggaccgaatgttgcgtctcttggcttgttacaatatcctcacttgttctgttcgtactcaacaagatggaaaggttcagagactttatggtttggctactgttgctaa

SEQ ID NO: 24948 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24949 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaactgatgcaccagttatgttggaccgtatgttgcgtctcttggcttgttacaatatcctcacttgttcagttcgtactcaacaagatggaaaggttcagagactttatggtttggctactgttgctaa

SEQ ID NO: 24950 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24951 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24952 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24953 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 24954 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacatttatgttggaccgaatgttgcgtctcttggcttgttacaatatcctcacttgttctgttcgtactcaacaagatggaaaggttcagagactttatggtttggctactgttgctaa

SEQ ID NO: 24955 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 24956 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24957 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacatgatgcaccatttatgttggaccgaatgttgcgtctcttggcttgttacaatatcctcacttgttcagttcgtactcaacaagatggaaagattcagagactttatggtttggctactgttgctaa

SEQ ID NO: 24958 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacatgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 24959 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24960 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24961 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24962 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24963 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 24964 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24965 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24966 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24967 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 24968 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 24969 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24970 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24971 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatgatgcaccagttatgttggaccgaatgttgcgtctcttggcttgttacaatatcctcacttgtacagttcgtactcaacaagatggaaaggttcagagactttatggtttggctactgttgctaa

SEQ ID NO: 24972 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24973 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatatgttgcgtctcttggcttgttacaatatcctcacttgttcagttcgtactcaacaagatggaaagattcagagactttatggtttggctactgttgctaa

SEQ ID NO: 24974 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24975 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaagatggaaagattcagagactttatggtttggctactgttgctaa

SEQ ID NO: 24976 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24977 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24978 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24979 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaagattcagagactttatggttggctactgttgctaa

SEQ ID NO: 24980 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24981 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24982 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 24983 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24984 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24985 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactcaccagttatgttggaccgaatgttgcgtctcttggcttgttacaatatcctcacttgttcagttcgtactcaacaagatggaaaggttcagagactttatggtttggctactgttgctaa

SEQ ID NO: 24986 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactagcaccagttatgttggaccgaatgttgcgtctcttggcttgttacaatatcctcacttgttcagttcgtactcaacaagatggaaagattcagagactttatggtttggctactgttgctaa

SEQ ID NO: 24987 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24988 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaccgaatgttgcgtctcttggcttgttacaatatcctcacttgttcagttcgtactcaacaagatggaaaggttcagagactttatggtttggctactgttgctaa

SEQ ID NO: 24989 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24990 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 24991 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24992 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24993 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24994 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24995 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 24996 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 24997 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24998 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 24999 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 25000 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 25001 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25002 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25003 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25004 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25005 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaataaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25006 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25007 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacgttggaccgaatgttgcgtctcttggcttgttacaatatccgcacttgttcagttcgtactcaacaagatggaaaggttcagagactttatggtttggctactgttgctaa

SEQ ID NO: 25008 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25009 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25010 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25011 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacatctcgtaaccgtatcgatatgctctcaaccggcattaaaagcccctgatgcaccagttatgttggaccgaatgttgcgtctcttggcttgttacaatatcctcacttgtgcagttcgtactcaacaagatggaaagattcagagactttatggtttggctactgttgctaa

SEQ ID NO: 25012 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25013 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25014 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25015 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacacgcaccagttatgttggaccgaatgttgcgtctcttggcttgttacaatatcctcacttgttcagttcgtactcaacaagatggaaaggttcagagactttatggtttggctactgttgctaa

SEQ ID NO: 25016 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25017 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 25018 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25019 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25020 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25021 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaatgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 25022 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25023 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaatatgcaccagttatgttggaccgaatgttgcgtctcttggtttgttacaatatcctcacttgttcagttcgtactcaacaagatggaaaggttcagagactttatggtttggctactgttgctaa

SEQ ID NO: 25024 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25025 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 25026 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaacttatcttcgagccagccacgatcgacattgatctgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25027 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgtttaaccgaatagttcgtctcttgtcttgttacaatatcctcactttttcatttcttactcaacaagattcaaaatttcacagactttattgtttgtctactatttctaa

SEQ ID NO: 25028 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25029 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25030 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttgggctactgttgctaa

SEQ ID NO: 25031 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggctggttacaatatcctcacttgttcagttcgtactcaacaagatggaaaggttcagagactttatggtttggctactgttgctaa

SEQ ID NO: 25032 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25033 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25034 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25035 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25036 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactagccaggcccacggcttgaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25037 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25038 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25039 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaacgccattatctccgacgcactgaaccacgcgtctattattgatggtgtgcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25040 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25041 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25042 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaacccgctggaccgtctccagcgcctgcttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25043 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaacagataaaacgaaaggcccagtcttctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25044 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25045 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25046 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25047 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaacaccagttatgttggaccgaatgttgcgtctcttggcttgttacaatatcctcacttgttctgttcgtactcaacaagatggaaagattcagagactttatggtttggctactgttgctaa

SEQ ID NO: 25048 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25049 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25050 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25051 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttcccagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25052 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttcacagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25053 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagactttatggtttggctactgttgctaa

SEQ ID NO: 25054 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagactttatggtttggctactgttgataa

SEQ ID NO: 25055 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcgtctcttggcttgttacaatatcctcacttgttcagttcgtactcaacaagatggaaagattcagagactttatggtttggctactgttgctaa

SEQ ID NO: 25056 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcgtctcttggcttgttacaatatcctcacttgttcagttcgtactcaacaagatggaaaggttcagagactttatggtttggctactgttgctaa

SEQ ID NO: 25057 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25058 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25059 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcaccagtcatgttggaccaaatgttgcgtctcttggcttgttacaatatcctcacttgttctgttcgtactcaacaagatggaaaggttcagagactttatggtttggctactgttgctaa

SEQ ID NO: 25060 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25061 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattaccctgatgcaccagtcatgttggaccgaatgttgcgtctcttggcttgttacaatatcctcacttgttcagttcgtactcaacaagatggaaagattcagagactttatggtttggctactgttgcta

SEQ ID NO: 25062 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattaccctgatgcaccagtcatgttggaccgaatgttgcggctcttggcttgttacaatatcctcacttgtgctgttcgtactcaacaagatggaaaagttcagagactttatggtgtggctactgtggctaa

SEQ ID NO: 25063 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaatggcttctcagcttccaacaaccagtcatgttggaccgaattttgcgtcgcttggcttgttacaatatcctcacttgttcagttcgtactcaacaagatggaaaagtacagagactttatggtttggctactgttgctaa

SEQ ID NO: 25064 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgtccaaattgcgtctcttggcttgttacaatatcctcacttgttcagttcgtactcaacaagatggaaaggttcagagactttatggtttggctactgttgctaa

SEQ ID NO: 25065 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctggtcaaattgcttctcagcttgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25066 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgatcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25067 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatttaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25068 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatttaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25069 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatttaaattgcttctcagctaccaatgcaccagttatgttggaccgaattttgcgtctcttggcttgttacaatatcctcactttttcagttcgtactcaacaagatggaaaagttcagagactttatggtttggctactgttgctaa

SEQ ID NO: 25070 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgtaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25071 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgtaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25072 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattggaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25073 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgcaattgcttctcagctcccaacacctgatgcaccagttatgttggaccgaatgttgcgtctcttggcttgttacaatatcctcacttgttcagttcgtactcaacaagatggaaaggttcagagactatatggattggcgactgttactaa

SEQ ID NO: 25074 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgagattgcttctcagctcccaacaactgagcctttcgttttatctgttgtgtggcggtgagcgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25075 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgagattgcttctcagctccagttatgttggaccgaatgttgcgtctcttggcttgttacaatatcctcacttgttcagttcgtactcaacaagatggaaagattcagagactttatggtttggctactgttgctaa

SEQ ID NO: 25076 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgagattgcttctcagctaccatgcaccagttatgttggaccggatgttgcgtctcttggcttgttacaatatcctcacttgttcagttcgtactcaacaagatggaaaggttcagagactttatggtttggctactgttgctaa

SEQ ID NO: 25077 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgacttgttacaatatcctcacttgttcagtttgtactcaacaagatggaaaggttcagagactttatggtttggctactgttgctaa

SEQ ID NO: 25078 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 25079 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgacttgttacaatatcctcacttgttcagttcgtactcaacaagatggaaaagttcagagactttatggtttggctactgttgctaa

SEQ ID NO: 25080 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgacttgttacaatatcctcacttgttcagttcgtactcaacaagatggaaagattcagagactttatggtttggctactgttgctaa

SEQ ID NO: 25081 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25082 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25083 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25084 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25085 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaagattcagagactttatggtttggctactgttgctaa

SEQ ID NO: 25086 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaagttgcttctcagctcgcaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25087 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaagttgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 25088 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatttcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25089 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaaggttcagagactttatggtttggctactgttgctaa

SEQ ID NO: 25090 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaagattcagagactttatggtttggctactgttgctaa

SEQ ID NO: 25091 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25092 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25093 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25094 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25095 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25096 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25097 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25098 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25099 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctccaaacaactgagcctttcgttttatctgttgtttgtcggtgaacgctctcctgagtaggacaaatccctgatgctccagttatgttggaccgaatgttgcgtctcttggcttgttacaatatcctctcttgttcagttcgtactcaacaagatggaaaggttcagagactttatggtttggctactgttgctaa

SEQ ID NO: 25100 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctaccaacaactatgcaccagttatgttggaccgaatgtggcgtctcttggcttgttacaatatcctcacttgttcagttcgtactcaacaagatggaaagattcagagactttatggtttggctactgttgctaa

SEQ ID NO: 25101 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctaccaacaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 25102 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgttacaatatcctcacttgttcagttcgtactcaacaagatggaaaggttcagagactttatggtttggctactgttgctaa

SEQ ID NO: 25103 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 25104 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgttacaatatcctcacttgttcagttcgtactcaacaagatggaaagattcagagactttatggtttggctactgttgctaa

SEQ ID NO: 25105 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgttacaatatcctcacttgttcagttcgtactcaacaagatggaagagttcagagactttatggtttggctactgttgctaa

SEQ ID NO: 25106 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttttcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25107 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctttcagctcccaacaactgatgcaccagttatgttggaccgaatgttgcgtctcttggtttgttacaatatcctcacttgttcagttcgtactcaacaagatggaaagattcagagactttatggtttggctactgttgctaa

SEQ ID NO: 25108 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttgtcagctcccaacaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25109 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaggttcagagactttatggtttggctactgttgctaa

SEQ ID NO: 25110 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttctgttcgtactcaacaagatggaaaggttcagagactttatggtttggctactgttgctaa

SEQ ID NO: 25111 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaaggttcagagactttatggtttggctactgttgctaa

SEQ ID NO: 25112 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaagattcagagactttatggtttggctactggtgctaa

SEQ ID NO: 25113 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaagattcagagactttatggtttggctactgttgctaa

SEQ ID NO: 25114 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttagctcccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25115 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttagctaccaacaacttgcgtctcttggcttgttacaatatcctcacttgttcagttcgtactcaacaagatggaaaggttcagagactttatggtttggctactgttgctaa

SEQ ID NO: 25116 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctctgctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25117 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctgatgcaccagttatgttggaccgaatgttgcgtctattggcttgttacaatatcctcacttgttcagttcgttctcaacaagatggaaaggttcagagactttatggtttggctactgatgctaa

SEQ ID NO: 25118 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25119 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25120 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 25121 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 25122 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25123 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25124 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaacaacttgcgtctcttggcttgttacaatatcctcacttgttcagttcgtactcaacaagatggaaaggttcagagactttatggtttggctactgttgctaa

SEQ ID NO: 25125 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25126 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25127 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaagattcagagactttatggtttggctactgttgctaa

SEQ ID NO: 25128 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 25129 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25130 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 25131 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25132 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaggatgcaccagttatgttggaccgaatgttgtgtctcttggcttgttacaatatcctcacttgttcagttcgtactcaacaagatggaaaggttcagagactttatggtttggctactgttgctaa

SEQ ID NO: 25133 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25134 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttcagttcgtactcaacaagatggaaagattcagagactttatggtttggctactgttgctaa

SEQ ID NO: 25135 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25136 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25137 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 25138 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25139 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 25140 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttctgttcgtactcaacaagatggaaagattcagagactttatggtttggctactgttgctaa

SEQ ID NO: 25141 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25142 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25143 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25144 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaactgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 25145 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25146 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25147 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25148 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25149 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25150 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacatgcaccagtcatgttggaccgaatgttgcgtctcttggcttgttacaatatcctcacttgttctgttcgtactcaacaagatggaaagattcagagactttatggtttggctactgttgctaa

SEQ ID NO: 25151 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25152 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25153 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25154 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaatatgcaccagtcatgttggaccgaatgttgcgtctcttggcttgttacaatatcctcacttgttctgttcgtactcaacaagatggaaagattcagagactttatggtttggctactgttgctaa

SEQ ID NO: 25155 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaacttatcccctgattctgtggataaccgtattaccgcctttgagtgagccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25156 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25157 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25158 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25159 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25160 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactctccaggggaagccgaagtttccaaaaggtctttgatcaaagctcgccgcgttgtttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25161 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25162 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25163 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaacccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25164 - DNA, 366 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaacccctgagcaccaagtttgttgggccgaattttgcctccctttggtttgtacaattacctcccctggtcaggtccttctcaaccaaaaggaaaagttcagaggctttatgggttggctactggtgctaa

SEQ ID NO: 25165 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaacgtactcaacaagatggaaaggttcagagactttatggtttggctactgttgctaa

SEQ ID NO: 25166 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaacgtactcaacaagatggaaaggttcagagcctttatggtttggctactgttgctaa

SEQ ID NO: 25167 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagttatgttggaccgaatgttgcgtctcttggcttgttacactatcctcacttgttcagttcgtactcaacaagatggaaaggttcagagactttatggtttggctactgttgctaa

SEQ ID NO: 25168 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25169 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25170 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25171 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25172 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25173 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgcaccagttatgttggaccgaatgttgcgtctcttggcttgttacaatatcctcacttgttcagttcgtactcaacaagatggaaaggttcagagactttatggtttggctactgttgctaa

SEQ ID NO: 25174 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgcaccagttatgttggaccgaatgttgcgtctcttggcttgttacaatatcctcacttgttcagttcgtactcaacaagatggaaagattcagagactttatggtttggctactgttgctaa

SEQ ID NO: 25175 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgcaccagttatgttggaccgaatgttgcgtctcttggcttgtcacaatatcctcacttgttcagttcgtactcaacaagatggaaagattcagagactttatggtttggctactgttgctaa

SEQ ID NO: 25176 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgcaccagttatgttggaccgaatgttgcgtctcttggcttgttacaatatcctcacttgttcagttcatactcaacaagatggaaagattcagagactttatggtttggctactgttgctaa

SEQ ID NO: 25177 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgcaccagttatgttggaccgaatgttgcgtctattggcttgttacaatatcctcacttgttcagttcgtactcaacaagatggaaagattcagagactttatggtttggctactgttgctaa

SEQ ID NO: 25178 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgcaccagttatgttggaccgaatgttgcgtctcttggcttgttacaatatcctcacttgttcagttcgtactcaacaagatggaaaagttcagagactttatggtttggctactgttgctaa

SEQ ID NO: 25179 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25180 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25181 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcactcgttcagttcgtactcaacaagatggaaagattcagagactttatggtttggctactgttgctaa

SEQ ID NO: 25182 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25183 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25184 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 25185 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 25186 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25187 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25188 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25189 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 25190 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 25191 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcactagttatgttggaccgaatgttgcgtctcttggcttgttacaatatcctcacttgttcagttcgtactcaacaagatggaaagattcagagactttatggtttggctactgttgctaa

SEQ ID NO: 25192 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaagttcagagactttatggtttggctactgttgctta

SEQ ID NO: 25193 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25194 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttgccttgttacaatatcctcacttgttcagttcgtactcaacaagatggaaaagttcagagactttatggtttggctactgttgctaa

SEQ ID NO: 25195 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25196 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25197 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttctaa

SEQ ID NO: 25198 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagacttcatggtttggctactgttgctaa

SEQ ID NO: 25199 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25200 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25201 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 25202 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggctttttacattatcctcacttgttcagttcgtactcaacaagatggaaagattcagagactttatggtttggctactgttgctaa

SEQ ID NO: 25203 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25204 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 25205 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25206 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctaactgatgcaccagttatgttggaccgaatgttgcgtctcttggcttgttacaatatcctcacttgttcagttcgtactcaacgagatggaaagattcagagactttatggtttggctactgttgctaa

SEQ ID NO: 25207 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25208 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctaacaagttatgttggaccgaatgttgcgtctcttggcttgttacaatatcctcacttgttcagttcgtactcaacaagatggaaaagttcagagactttatggtttggctactgttgctaa

SEQ ID NO: 25209 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctaacaagttatgttggaccgaatgttgcgtctcttggcttgttacaatatcctcacttgttcagttcgtactcaacaagatggaaagattcagagactttatggtttggctactgttgctaa

SEQ ID NO: 25210 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccctacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25211 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccctacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25212 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 25213 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccgacatgcaccagttatgttggaccgaatgttgcgtctcttgacttgttacaatatcctcacttgttcagttcgtactcaacaagatggaaagattcagagactttatggtttggctactgttgctaa

SEQ ID NO: 25214 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccgacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25215 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25216 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25217 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 25218 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccatgatgcaccagttatgttggaccgaatgttgcgtctcttggcttgttacaatatcctcacttgttcagttcatactcaacaagatggaaaggttcagagactttatggtttggctactgttgctaa

SEQ ID NO: 25219 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25220 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25221 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccatgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 25222 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagccactcagccgcgggtttctggagtttaatgagctaagcacatacgtcagaaaccattattgcgcgttcaaaagtcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25223 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagccactcagccgcgggtttctggagtttaatgagctaagcacatacgtcagaaaccattattgcgcgttcaaaagtcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25224 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagccactcagccgcgggtttctggagtttaatgagctaagcacatacgtcagaaatcattattgcgcgttcaaaagtcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25225 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagcaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25226 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25227 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25228 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25229 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactattgctaa

SEQ ID NO: 25230 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 25231 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25232 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25233 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25234 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctattggcttgttacaatatcctcacttgttcagttcgtactcaacaagatggaaagattcagagactttatggtttggctactgttgctaa

SEQ ID NO: 25235 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25236 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 25237 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaaggtggaaaggttcagagactttatggtttgtctactgttgctaa

SEQ ID NO: 25238 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 25239 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25240 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25241 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25242 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaatggttcagagactttatggtttggctactgttgctaa

SEQ ID NO: 25243 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25244 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatgggttggctactgttgctaa

SEQ ID NO: 25245 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggcttctgttgctaa

SEQ ID NO: 25246 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcatactcaacaagatggaaagattcagagactttatggtttggctactgttgctaa

SEQ ID NO: 25247 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaagattcagagactttatggtttggctactgttgctaa

SEQ ID NO: 25248 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggcactgttgctaa

SEQ ID NO: 25249 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtacgcaacaagatggaaagattcagagactttatggtttggctactgttactaa

SEQ ID NO: 25250 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25251 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25252 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25253 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 25254 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctag

SEQ ID NO: 25255 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgtgtctcttggcttgttacaatatcctcacttgttctgttcgtactcaacaagatggaaaggttcagagactttatggtttggctactgttgctaa

SEQ ID NO: 25256 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcatctcttggcttgttacaatatcctcacttgttcagttcgtactcaacaagatggaaaagttcagagactttatggtttggctactgttgctaa

SEQ ID NO: 25257 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtcacttggcttgttacaatatcctcacttgttcagttcgtactcaacaagatggaaagattcagagactttatggtttggctactgttgctaa

SEQ ID NO: 25258 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactggtgctaa

SEQ ID NO: 25259 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttctgttcgtactcaacaagatggaaagattcagagactttatggtttggctactgttgctaa

SEQ ID NO: 25260 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25261 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatacaccagttatgttggaccgaatgttgcgtctcttggcttgttacaatatcctcacttgttcagttcgtactcaacaagatggaaaggttcagagactttatggtttggctactgttgctaa

SEQ ID NO: 25262 - DNA, 479 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatcacctgctggggggtcaagccgtgggccgggcaccgccccggcaacagccgctggaccgtctccagcgcctgcttgccgccatcgtggctggcgatggccaccacctgctccggggtcaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25263 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25264 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgtttagttcgtactcaacaagatggaaaagttcagagactttatggtttggctactgttgctaa

SEQ ID NO: 25265 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 25266 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaaggttcagagactttatggtttggctattgttgctaa

SEQ ID NO: 25267 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaagattcagagactttatggtttggctatgttgctaa

SEQ ID NO: 25268 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaagattcagagactttatggtttggctactgttgctaa

SEQ ID NO: 25269 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaaggttcagagactttatggtttggctactgttgctaa

SEQ ID NO: 25270 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgatcagttcgtactcaacaagatggaaagattcagagactttatggtttggctactgttgctaa

SEQ ID NO: 25271 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaaagttcagagactttatggtttggctactgttgctaa

SEQ ID NO: 25272 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaggtgtacggctacaggggcaagcacctgggcggctccagatgcaccagttatgttggaccgaatgttgcgtctcttggcttgttacaatatcctcacttgttcagttcgtactcaacaagatggaaagattcagagactttatggtttggctactgttgctaa

SEQ ID NO: 25273 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaggtgtacggctacaggggcaagcacctgggcggctccagatgcaccagttatgttggaccgaatgttgcgtctcttggcttgttacaatatcctcactttttcagttcgtactcaacaagatggaaaggttcagagactttatggtttggctactgttgctaa

SEQ ID NO: 25274 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaggtgtacggctacaggggcaagcacctgggcggctccagatgcaccagttatgttgggccgaatgttgcgtctcttggcttgttacaatatcctcacttgttcagttcgtactcaacaagatggaaagattcagagactttatggtttggctactgttgctaa

SEQ ID NO: 25275 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaggtgtacggctacaggggcaagcacctgggcggctccagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25276 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttgtgttggaccgaatgttgcgtctcttggcttgttacaatatcctcacttgttcagttcgtactcaacaagatggaaaggttcagagactttatggtttggctactgttgctaa

SEQ ID NO: 25277 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggactgaatgttgcgtctcttggcttgttacaatatcctcacttgttcagttcgtactcaacaagatggaaaggttcagagactttatggtttggctactgttgctaa

SEQ ID NO: 25278 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25279 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttgctactgttgctaa

SEQ ID NO: 25280 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 25281 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25282 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctta

SEQ ID NO: 25283 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25284 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 25285 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgatgcgtctcttggcttgttacaatatcctcacttgttcagttcgtactcaacaagatggaaaggttcagagactttatggtttggctactgttgctaa

SEQ ID NO: 25286 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcactcgttcagttcgtactcaacaagatggaaaggttcagagactttatggtttggctactgttgctaa

SEQ ID NO: 25287 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacttgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 25288 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25289 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25290 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacttatgttggaccgaatgttgcgtctcttggcttgttacaatatcctcacttgttcagttcgtactcaacaagatggaaagattcagagactttatggtttggctactgttgctaa

SEQ ID NO: 25291 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacttatgttggaccgaatgttgcgtctcttggcttgttacaatatcctcacttgttcagttcgtactcaacaagatggaaaggttcagagactttatggtttggctactgttgctaa

SEQ ID NO: 25292 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacttatgttggaccgaatgttgcgtctcttggtttgttacaatatcctcacttgttcagttcgtactcaacaagatggaaagattcagagactttatggtttggctactgttgctaa

SEQ ID NO: 25293 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgtaccagttatgttggaccgaatgttgcgtctcttggcttgttacaatatcctcacttgttcagttcgtactcaacaagatggaaagattcagagactttatggtttggctactgttgctaa

SEQ ID NO: 25294 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccggttatgttggaccgaatgttgcgtctcttggcttgttacaatatcctcacttgttcagttcgtactcaacaagatggaaagattcagagactttatggtttggctactgttgctaa

SEQ ID NO: 25295 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 25296 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttgggccgaatgttgcgtctcttggcttgttacaatatcctcacttgttcagttcgtactcaacaagatggaaagattcagagactttatggtttggctactgttgctaa

SEQ ID NO: 25297 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25298 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25299 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25300 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaggttcagagactttatggtttggctactgttgctaa

SEQ ID NO: 25301 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttattcagttcgtactcaacaagatggaaaggttcagagactttatggtttggctactgttgctaa

SEQ ID NO: 25302 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25303 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagtacgtactcaacaagatggaaagattcagagactttatggtttggctactgttgctaa

SEQ ID NO: 25304 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgtgtctcttggcttgttacaatatcctcacttgttcagttcgtactcaacaagatggaaagattcagagactttatggtttggctactgttgctaa

SEQ ID NO: 25305 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttctaa

SEQ ID NO: 25306 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 25307 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggttactgttgctaa

SEQ ID NO: 25308 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcatgttacaatatcctcacttgttcagttcgtactcaacaagatggaaagattcagagactttatggtttggctactgttgctaa

SEQ ID NO: 25309 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 25310 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 25311 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgatacaatatcctcacttgttcagttcgtactcaacaagatggaaagattcagagactttatggtttggctactgttgctaa

SEQ ID NO: 25312 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcttactcaacaagatggaaagattcagagactttatggtttggctactgttgctaa

SEQ ID NO: 25313 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaattttgcctcccttggcttgttacaatatcctcccttgttcaggtcgttctcaacaaaattgaaagattcagagactttatggtttggctactgttgctaa

SEQ ID NO: 25314 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25315 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaaggtggaaagattcaaagactttatggtttggctactgttgctaa

SEQ ID NO: 25316 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatttcctcacttgttcagttcgtactcaacaagatggaaaggttcagagactttatggtttggctactgttgctaa

SEQ ID NO: 25317 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatttcctcacttgttcagttcgtactcaacaagatggaaagattcagagcctttatggtttggctactgtggctaa

SEQ ID NO: 25318 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagtgactttatggtttggctactgttgctaa

SEQ ID NO: 25319 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctacggttgctaa

SEQ ID NO: 25320 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 25321 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 25322 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggctggttacaatatcctcacttgttcagttcgtactcaacaagatggaaagattcagagactttatggtttggctactgttgctaa

SEQ ID NO: 25323 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttgaaccgaatgttgcatctcttggcttgttacaatatcctcacttgttcagttcgtactcaacaagatggaaagattcagagactttatggtttggctactgttgctaa

SEQ ID NO: 25324 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25325 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25326 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagtcatgttggaccgaatgttgcgtctcttggcttgttacaatatcctcatttgttctgttcgtactcaacaagatggaaaggttcagagactttatggtttggctactgttgctaa

SEQ ID NO: 25327 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25328 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25329 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaagattcagagactttatggtttggctactgttgctaa

SEQ ID NO: 25330 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25331 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25332 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25333 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25334 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactactgatgcaccagttatgtcggaccgaatgttgcgtctcttggcttgttacaatatcctcacttgttctgttcgtactcaacaagatggaaaggttcagagactttatggtttggctactgttgctaa

SEQ ID NO: 25335 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25336 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactaaccctgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 25337 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25338 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25339 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgtgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25340 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25341 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25342 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacatgatggaaaggttcagagacttcatggtttggctactgttgctaa

SEQ ID NO: 25343 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25344 - DNA, 382 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 25345 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgccatcgtggctggcgatggccaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25346 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgccatcgtggctggcgatggccaccttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25347 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccggcaacagccgctggaccgtctccagcgcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25348 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 25349 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtacttaacaagatggaaagattcagagactttatggtttggctactgttgctaa

SEQ ID NO: 25350 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 25351 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 25352 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttctgttcgtactcaacaagatggaaaggttcagagactttatggtttggctactgttgctaa

SEQ ID NO: 25353 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25354 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25355 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25356 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25357 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggcccgaatgttgcgtctcttggcttgttacaatctcctcacttgttcagttcgtactcaacaagatggaaaggttcagagactttatggtttggctactgttgctaa

SEQ ID NO: 25358 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25359 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttagggtttggctagttgctaa

SEQ ID NO: 25360 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25361 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25362 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 25363 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaaggtggcgtcacttggcttgttacaatatcctcacttgttcagttcgtactcaacaagatggaaagattcagagactttatggtttggctactgttgctaa

SEQ ID NO: 25364 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagatactttatggtttggctactgttgctaa

SEQ ID NO: 25365 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 25366 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaattttgcgtctcttggctttttacaatatcctcacttgttcagttcgtactcaacaagatggaaagattcagagactttatggtttggctactgttgctaa

SEQ ID NO: 25367 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggcctactgttgctaa

SEQ ID NO: 25368 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 25369 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 25370 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 25371 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgccaa

SEQ ID NO: 25372 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25373 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctccctttttcagttcgtactcaacaagatggaaagattcagagactttatggtttggctactgttgctaa

SEQ ID NO: 25374 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgtgcagttcgtactcaacaagatggaaaggttcagagactttatggtttggctactgtgctaa

SEQ ID NO: 25375 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 25376 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 25377 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 25378 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 25379 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25380 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25381 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattctgagactttatggtttggctactgttgctaa

SEQ ID NO: 25382 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25383 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctacttgctaa

SEQ ID NO: 25384 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25385 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25386 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25387 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 25388 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25389 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25390 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaaggttcagagactttatggtttggctactgttgctaa

SEQ ID NO: 25391 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaagattcagagactttatggtttggctactgttgctaa

SEQ ID NO: 25392 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaaagttcagagactttatggttggctactgttgctaa

SEQ ID NO: 25393 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttctgttcgtactcaacaagatggaaaggttcagagactttatggtttggctactgttgctaa

SEQ ID NO: 25394 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagatgcaccagttatgttggaccgaatgttgcgtctcttggcttgttacaatatcctcacttgttcagttcgtactcaacaagatggaaagattcagagactttatggtttggctactgttgctaa

SEQ ID NO: 25395 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccactgatgcaccagttatgttgtaccgaatgttgcgtctcttggcttgttacaatatcctcacttgttcagttcgtactcaacaagatggaaatgttcagagactttatggtttggctactgttgctaa

SEQ ID NO: 25396 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatttatgttggaccgaatgttgcgtctcttggcttgttacaatatcctcacttgttcagttcgtactcaacaagatggaaaggttcagagactttatggtttggctactgttgctaa

SEQ ID NO: 25397 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatttatgttggaccgaatgttgcgtctcttggcttgttacaatatcctcgcttgttcagttcgtactcaacaagatggaaaggttcagagactttatggtttggctactgttgctaa

SEQ ID NO: 25398 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatttatgttggaccgaatgttgcgtctcttggcttgttacaatatcctcacttgttcagttcgtactcaacaagatggaaaagttcagagactttatggtttggctactgttgctaa

SEQ ID NO: 25399 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatttatgttggaccgaatgttgcgtctcttggcttgttacaatatcctcacttgttctgttcgtactcaacaagatggaaaggttcagagactttatggtttggctactgttgctaa

SEQ ID NO: 25400 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaagattcagagactttatggtttggctactgttgctaa

SEQ ID NO: 25401 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaaggttcagagactttatggtttggctactgttgctaa

SEQ ID NO: 25402 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcacctgttatgttggaccgaatgttgcgtctcttggcttgttacaatatcctcacttgttcagttcgtactcaacaagatggaaagattcagagactttatggtttggctactgttgctaa

SEQ ID NO: 25403 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25404 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 25405 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25406 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagaccttatggtttggctactgttgctaa

SEQ ID NO: 25407 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25408 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagacggaaagattcagagactttatggtttggctactgttgctaa

SEQ ID NO: 25409 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgcctaa

SEQ ID NO: 25410 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25411 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 25412 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaaagttcagagactttatggtttggctactgttgctaa

SEQ ID NO: 25413 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaacgttcagagactttatggtttggctactgttgctaa

SEQ ID NO: 25414 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaagattcagagactttatggtttggctactgttgctaa

SEQ ID NO: 25415 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttgtcttgttacaatatcctcacttgttcagttcgtactcaacaagatggaaaggttcagagactttatggtttggctactgttgctaa

SEQ ID NO: 25416 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgtggcgtctcttggcttgttacaatatcctcacttgttcagttcgtactcaacaagatggaaaggttcagagactttatggtttggctactgttgctaa

SEQ ID NO: 25417 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtctggatactgttgctaa

SEQ ID NO: 25418 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttccgttcgtactcaacaagatggaaagattcagagactttatggtttggctactgttgctaa

SEQ ID NO: 25419 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgct

SEQ ID NO: 25420 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaataccctcacttgttcagtccgtactcaacaagatggaaaggttcagagactttatggtttggctactgttgctaa

SEQ ID NO: 25421 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatagcctcacttgttcagttcgtactcaacaagatggaaagattcagagactttatggtttggctactgttgctaa

SEQ ID NO: 25422 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggctcagagactttatggtttggctactgttgctaa

SEQ ID NO: 25423 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25424 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtacccaacaagatggaaagattcagagactttatggtttggctactgttgctaa

SEQ ID NO: 25425 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 25426 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatgggaagattcagagactttatggtttggctactgttgctaa

SEQ ID NO: 25427 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagatttagagactttatggtttggctactgttgctaa

SEQ ID NO: 25428 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagagggaaaggttcagagactttatggtttggctactgttgctaa

SEQ ID NO: 25429 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggctcgttacaatatcctcacttgttcagttcgtactcaacaagatggaaaggttcagagactttatggtttggctactgttgctaa

SEQ ID NO: 25430 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25431 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcgacaagatggaaagattcagagactttatggtttggctactgttgctaa

SEQ ID NO: 25432 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25433 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25434 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 25435 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25436 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggctagatacaatatcctcacttgttcagttcgtactcaacaagatggaaaggttcagagactttatggtttggctactgttgctaa

SEQ ID NO: 25437 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 25438 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25439 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttctgttcgtactcaacaagatggaaagattcagagactttatggtttggctactgttgctaa

SEQ ID NO: 25440 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 25441 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatccccacttgttcagttcgtactcaacaagatggaaagattcagagactttatggtttggctactgttgctaa

SEQ ID NO: 25442 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcagcaagatggaaagattcagagactttatggtttggctactgttgctaa

SEQ ID NO: 25443 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggttactgttgctaa

SEQ ID NO: 25444 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctagttgctaa

SEQ ID NO: 25445 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttgggttgttacaatatcctcacttgttctgttcgtactcaacaagatggaaaggttcagagactttatggtttggctactgttgctaa

SEQ ID NO: 25446 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25447 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctacctgttgctaa

SEQ ID NO: 25448 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25449 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 25450 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25451 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 25452 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 25453 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 25454 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 25455 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25456 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 25457 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctctcggcttgttacagtatcctcacttgttcagttcgtactcaacaagatggaaaagttcagagactttatggtttggctactgttgctaa

SEQ ID NO: 25458 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 25459 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25460 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25461 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatcctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25462 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgttcagttcgtactcaacaagatggaaagattcagagactttatggtttggctactgttgctaa

SEQ ID NO: 25463 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgttcagttcgtactcaacaagatggaaaggttcagagactttatggtttggctactgttgctaa

SEQ ID NO: 25464 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgttcagttcgtactcaaccagatggaaaggttcagagactttatggtttggctactgttgctaa

SEQ ID NO: 25465 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25466 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaagattcagagactttatggtttggctactgttgctaa

SEQ ID NO: 25467 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcatactcaacaagatggaaaggttcagagactttatggtttggctactgttgctaa

SEQ ID NO: 25468 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25469 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 25470 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaagattcagagactttatggtttggctactgttgctaa

SEQ ID NO: 25471 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaagttcagagactttatggtttggctactgttgctaa

SEQ ID NO: 25472 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggacgaatgttgcgtctcttggcttgttacaatatcctcacttgttcagttcgtactcaacaagatggaaaggttcagagactttatggtttggctactgttgctaa

SEQ ID NO: 25473 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaagattcagagactttatggtttggctactgttgctaa

SEQ ID NO: 25474 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 25475 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgcttaa

SEQ ID NO: 25476 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttcttacaatatcctcacttgttcagttcgtactcaacaagatggaaaggttcagagactttatggtttggctactgttgctaa

SEQ ID NO: 25477 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgcaa

SEQ ID NO: 25478 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaagttcagagactttatggtttggctactgttgctaa

SEQ ID NO: 25479 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttatgttggaccaaatgttgcgtctcttggcttgttacaatatcctcacttgttcagttcgtactcaacaagatggaaaggttcagagactttatggtttggctactgttgctaa

SEQ ID NO: 25480 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaggtggtggccatcgccagcagtggcggtggcaagcaggcgctggagacggtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25481 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaggtggtggccatcgccagcaatggcggtggcaagcaggcgctggagacggtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25482 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaggtggtggccatcgccagcaatggcggtggcaagcaggcgctggagacggtctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25483 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaggtggtggccatcgccagcaatggcggtggcaagcaggcgctggagacggtctctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 25484 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaggtggtggccatcgccagcaataatggtggcaagcaggcgctggagacggtctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25485 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaggtggtggccatcgccagcaaataatggtggcaagcaggcgctggagacggtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25486 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagctaacctgatgcaccagtgatgttggaccgaatgttgcgtctcttgggtggttacaatatcctcacttgttcagtccgtactcagcaagatggaaaggttcagagactttatggtttggctactgttggtaa

SEQ ID NO: 25487 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25488 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagcctgatgcaccagttatgttggaccgaatgttgcgtctcttggcttgttacaatatcctcacatgttcagttcgtactcaacaagatggaaagattcagagactttatggtttggctactgttgataa

SEQ ID NO: 25489 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagccagcaatggcggcggcaggccggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25490 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagccagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25491 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagccagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgataa

SEQ ID NO: 25492 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgtaccagttatgttggaccgaatgttgcgtctcttggcttgttacaatatcctcacttgttcagttcgtactcaacaagatggaaaggttcagagactttatggtttggctactgttgctaa

SEQ ID NO: 25493 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttgtgttggaccgaatgttgcgtctcttggcttgttacaatatcctcacttgttcagttcgtactcaacaagatggaaagattcagagactttatggtttggctactgttgctaa

SEQ ID NO: 25494 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 25495 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttagcttgttacaatatcctcacttgttcagttcgtactcaacaagatggaaagattcagagactttatggtttggctactgttgctaa

SEQ ID NO: 25496 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25497 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttattacaatatcctcacttgttcagttcgtactcaacaagatggaaagattcagagactttatggtttggctattgttgctaa

SEQ ID NO: 25498 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcatttcgtactcaacaagatggaaagattcagagactttatggtttggctactgttgctaa

SEQ ID NO: 25499 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgcactcaacaagatggaaagattcagagactttatggtttggctactgttgctaa

SEQ ID NO: 25500 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25501 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcactcgttcagttcgtactcaacaagatggaaaggttcagagactttatggtttggctactgttgctaa

SEQ ID NO: 25502 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagactggtcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25503 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagactgggcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25504 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagactgggcctttcgttttatctgttgtttgtcggtgaacgctctccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25505 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagactgggcctttcgttttatctgttgtttgtcggtgaacgctctccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 25506 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagactgggcctttcgttttatctgttgtttgtcggtgaacgctctccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25507 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacttatgttggaccgaatgttgcgtctcttggcttgttacaatatcctcacttgttcagttcgtactcaacaagatggaaaagttcagagactttatggtttggctactgttgctaa

SEQ ID NO: 25508 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25509 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 25510 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25511 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25512 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25513 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 25514 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 25515 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 25516 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgatacaatatcctcacttgttctgttcgtactcaacaagatggaaagattcagagactttatggtttggctactgttgctaa

SEQ ID NO: 25517 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgcgaa

SEQ ID NO: 25518 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 25519 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 25520 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25521 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacatgttcagttcgtactcaacaagatggaaagattcagagactttatggtttggctactgttgctaa

SEQ ID NO: 25522 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctac

SEQ ID NO: 25523 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgttctcaacaagatggaaagattcagagactttatggtttggctactgttgctaa

SEQ ID NO: 25524 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 25525 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctacgttgctaa

SEQ ID NO: 25526 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaacgaatgtggcgtctcttggcatgttacaatatcctcacttgttcagttcgtactcaacaagatggaaagattcagagactttatggtttggctactgttgctaa

SEQ ID NO: 25527 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25528 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgtttagttcgtactcaacaagatggaaagattcagagactttatggtttggctactgttgctaa

SEQ ID NO: 25529 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25530 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25531 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25532 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25533 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25534 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25535 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacatgatggaaagattcagagactttatggtttggctactgttgctaa

SEQ ID NO: 25536 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcactagttatgttggaccgaatgttgcgtctcttggcttgttacaatatcctcccttgttcagttcgtactcaacaagatggaaaggttcagagactatatggtttggctactgttgctaa

SEQ ID NO: 25537 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggtccgaatgttgcgtctcttggcttgttacaatatcctcacttgttcagttcgtactcaacaagatggaaaggttcagagactttatggtttggctactgttgctaa

SEQ ID NO: 25538 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25539 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 25540 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25541 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25542 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgtgctgttcgtactcaacaagatggaaaggttcagagactttatggtttggctactgttgctaa

SEQ ID NO: 25543 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgtgtctcttggcttgttacaatatcctcacttgttcagttcgtactcaacaagatggaaaggttcagagactttatggtttggctactgttgcaa

SEQ ID NO: 25544 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25545 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 25546 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25547 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttctgttcgtacccaacaagatggaaaggttcagagactttatggtttggctactgttgctaa

SEQ ID NO: 25548 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 25549 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 25550 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25551 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25552 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacctagcaaatatttcttgtcaaaaatcctccacttacgttccataaattcccctcggtatccaatttgagtctcatattcactctcaatccaaataatgatgcaccagttatgttggaccgaatgttgcgtctcttggcatgttacaatatcctcccttgttcagttcgtactcaacaagatggaaagattcagagactttatggtttggctactgttgctaa

SEQ ID NO: 25553 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25554 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25555 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25556 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25557 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 25558 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaagattcagagactttatggtttggctactgttgctaa

SEQ ID NO: 25559 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaaggttcagagactttatggtttggctactgttgctaa

SEQ ID NO: 25560 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaagattcagagactttatggtttggctactgttgataa

SEQ ID NO: 25561 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccaccgccattgctggcgatggccaccacctgctggggggtcaagccgtgggccttgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25562 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccaccgccattgctggcgatggccaccacctgctggggggtcaagccgtgggccttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25563 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccaccgccattgctggcgatggccaccacctgctggggggtcaagccgtgggccttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25564 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25565 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaagattcagagactttatggtttggctactgttgctaa

SEQ ID NO: 25566 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaagattcagagactttatggtttggctactgttgctaa

SEQ ID NO: 25567 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaaggttcagagactttatggtttggctactgttgctaa

SEQ ID NO: 25568 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaagattcagagactttatggtttggctactgtctaa

SEQ ID NO: 25569 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaaagttcagagactttatggtttggctactgttgctaa

SEQ ID NO: 25570 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacaccagttatgttggaccgaatgttgcgtctcttggattgttacaatatcctcacttgttcagttcgtactcaacaagatggaaagattcagagactttatggtttggctactgttgctaa

SEQ ID NO: 25571 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttctgttcgtactcaacaagatggaaaggttcagagactttatggtttggctactgttgctaa

SEQ ID NO: 25572 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatttatgttggaccgaatgttgcgtctcttggcttgttacaatatcctcacttgttcagttcgtactcaacaagatggaaagattcagagactttatggtttggctactgttgctaa

SEQ ID NO: 25573 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatttatgttggaccgaatgttgcgtctcttggcttgttacaatatcctcacttgttcagttcgtactcaacaagatggaaaggttcagagactttatggtttggctactgttgctaa

SEQ ID NO: 25574 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatttatgttggaccgaatgttgcgtctcttggcttgttacaatatcctaacttgttcagttcgtactcaacaagatggaaagattcagagactttatggtttggctactgttgctaa

SEQ ID NO: 25575 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatttatgttggaccgaatgttgcgtctcttggcttgttacaatatcctcacttgttctgttcgtactcaacaagatggaaaggttcagagactttatggtttggctactgttgctaa

SEQ ID NO: 25576 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattgcaccagttatgttggaccgaatgttgcgtctcttgacttgttacaatatcctcacttgttcagttcgtactcaacaagatggaaagattcagagactttatggtttggctactgttgctaa

SEQ ID NO: 25577 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 25578 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgtgtctcttggcttgttacaatatcctcacttgttcagttcgtactcaacaagatggaaaggttcagagactttatggtttggctactgttgctaa

SEQ ID NO: 25579 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaaggttcagagactttatggtttggctactgttgctaa

SEQ ID NO: 25580 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaagattcagagactttatggtttggctactgttgctaa

SEQ ID NO: 25581 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaaggttcagagcctttatggtttggctactgttgctaa

SEQ ID NO: 25582 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgcgtctcttggattgttacaatatcctcacttgttctgttcgtactcaacaagatggaaaggttcagagactttatggtttggctactgttgctaa

SEQ ID NO: 25583 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttctgttcgtactcaacaagatggaaaggttcagagactttatggtttggctactgttgctaa

SEQ ID NO: 25584 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 25585 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaagattcagagactttatggtttggctactgttgctaa

SEQ ID NO: 25586 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttaaggtttggctactgttgctaa

SEQ ID NO: 25587 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttctgttcgtactcaacaagatggaaaggttcagagactttatggtttggctactgttgctaa

SEQ ID NO: 25588 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25589 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgatgctaa

SEQ ID NO: 25590 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcatctcttggcttgttacaatatcctcacttgttcagttcgtactcaacaagatggaaagattcagagactttatggtttggctactgttgctaa

SEQ ID NO: 25591 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgaa

SEQ ID NO: 25592 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25593 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 25594 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgttaa

SEQ ID NO: 25595 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttctgttcgtactcaacaagatggaaaggttcagagactttgtggtttggctactgttgctaa

SEQ ID NO: 25596 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25597 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtcgcttgggttgttacaatatcctcacttgttcagttcgtcctcaacaagatggaaaggttcagagactttatggtttggctactgttgctaa

SEQ ID NO: 25598 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctatgttgctaa

SEQ ID NO: 25599 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcactttttcagttcgtactcaacaagatggaaagattcagagactttatggtttggctactgttgctaa

SEQ ID NO: 25600 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagtacgtactcaacaagatggaaaggttcagagactttatggtttggctactgttgctaa

SEQ ID NO: 25601 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgatacaatatcctcacttgttcagttcgtactcaacaagatggaaaggttcagagactttatggtttggctactgttgctaa

SEQ ID NO: 25602 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagtttcagagactttatggtttggctactgttgctaa

SEQ ID NO: 25603 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25604 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25605 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25606 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25607 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttcctaa

SEQ ID NO: 25608 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgcta

SEQ ID NO: 25609 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaagttcagagactttatggtttggctatgttgctaa

SEQ ID NO: 25610 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcggagactttatggtttggctactgttgccaa

SEQ ID NO: 25611 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 25612 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaaagttgcgtctcttggcttgttacaatatcctcacttgttcagttcgtactcaacaagatggaaaggttcagagactttatggtttggctactgttgctaa

SEQ ID NO: 25613 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25614 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttactatatcctcacttgttcagttcgtactcaacaagatggaaaggttcagagactttatggtttggctactgttgctaa

SEQ ID NO: 25615 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttctgttcgtactcaacaagatggaaaggtacagagacgttatggtttggctactgttgctaa

SEQ ID NO: 25616 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctaatgttgctaa

SEQ ID NO: 25617 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgtgtctcttggcttgttacaatatcctcacttgttcagttcgtactcaacaagatggaaagattcagagactttatggtttggctactgttgctaa

SEQ ID NO: 25618 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgataa

SEQ ID NO: 25619 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 25620 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25621 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25622 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25623 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25624 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 25625 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 25626 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 25627 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgttgtgtctcttggcttgttacaatatcctcacttgttcagttcgtactcaacaagatggaaagattcagagactttatggtttggctactgttgctaa

SEQ ID NO: 25628 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaaggttcagagactttatggtttggctactgttgctaa

SEQ ID NO: 25629 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaagattcagagactttatggtttggctactgttgctaa

SEQ ID NO: 25630 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaagattcagagactttatggtttggccactgttgctaa

SEQ ID NO: 25631 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaagattcagagcctttatggtttggctactgttgctaa

SEQ ID NO: 25632 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttgtaccgaatgttgcgtctcttggcttgttacaatatcctcacttgttcagttcgtactcaacaagatggaaagattcagagactttatggtttggctactgttgctaa

SEQ ID NO: 25633 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 25634 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25635 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25636 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25637 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgtccagttcgtactcaacaagatggaaaggttcagagactttatggtttggctactgttgctaa

SEQ ID NO: 25638 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcaattcgtactcaacaagatggaaaagttcagagactttatggtttggctactgttgctaa

SEQ ID NO: 25639 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtcacttggcttgttacaatatcctcacttgttcaattcgtactcaacaagatggaaaagttcagagactttatggtttggctactgttgctaa

SEQ ID NO: 25640 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggacccaatggtgcgtcccctgggctggtacaatatcctcacttgttcagttcgttctcaacaagaaggaaaagttcagagactttaagggttggctactgttgctaa

SEQ ID NO: 25641 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25642 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25643 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25644 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagttatgttggaccgaatgttgcgtctcttggcttgttacaatatcctcacttgttcagttcgtactcaacaagatggaaagattcagagactttatggtttggctactgttgctaa

SEQ ID NO: 25645 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagttatgttggaccgaatgttgcgtctcttggcttgttacaatatcctcacttgttcagttcgtactcaacaagatggaaaggttcagagactttatggtttggctactgttgctaa

SEQ ID NO: 25646 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagttatgttggaccgaatgttgcgtctcttggcttgttacaatatcctcacttgttcggttcgtactcaacaagatggaaagattcagagactttatggtttggctactgttgctaa

SEQ ID NO: 25647 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcggctgttgccggtgctgtgccaggcccacggcttgaccccggagcaggtggtggccatcgccagcagttatctcgccctgatccggcgttggccgcgttgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25648 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcggctgttgccggtgcggggccaggcccacggcttgaccccggagcaggtggtggccatcgactgccctgctgcgtaacatcgttgctgctccataacatcaaacatcgacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25649 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcggctgttgccggtcctgtgccaggcccacggcttgaccccggagcaggtggtggccatcgactgccctgctgcgtaacatcgttgctgctccataacatcaaacatcgacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25650 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcaccagttatgttggaccgaatgttgcgtctcttggcttgttacaatatcctcacttgttcagttcgtactcaacaagatggaaagattcagagactttatggtttggctactgttgctaa

SEQ ID NO: 25651 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 25652 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcaatggcggcggcaggccggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25653 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25654 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgtaccagttatgttggaccgaatgttgcgtctcttggcttgttacaatatcctcacttgttcagttcgtactcaacaagatggaaaggttcagagactttatggtttggctactgttgctaa

SEQ ID NO: 25655 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 25656 - DNA, 276 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactttgctaa

SEQ ID NO: 25657 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccatttatgttggaccgaatgttgcgtctcttggcttgttacaatatcctcacttgttcagttcgtactcaacaagatggaaaggttcagagactttatggtttggctactgttgctaa

SEQ ID NO: 25658 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggactgaatgttgcgtctcttggcttgttacaatatcctcacttgttcagttcgtactcaacaagatggaaaggttcagagactttatggtttggctactgttgctaa

SEQ ID NO: 25659 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25660 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 25661 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagacgttatggtttggcgactgttactaa

SEQ ID NO: 25662 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25663 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25664 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggctgggtacaatatcctcacttgttcagttcgtactcaacaagatggaaaggttcagagactttatggattggctactgttgctaa

SEQ ID NO: 25665 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatgcaaagattcagagactttatggtttggctactgttgctaa

SEQ ID NO: 25666 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25667 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcggagactttatggtttggctactgttgctaa

SEQ ID NO: 25668 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttactatatcctcacttgttcagttcgtactcaacaagatggaaaagttcagagactttatggtttggctactgttgctaa

SEQ ID NO: 25669 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggtgcagagactttatggtttggctactgttgctaa

SEQ ID NO: 25670 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactttgtgcacgacgacatcattccgtggcgttatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25671 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactttgtgcacgacgacatcattccgtggcgttatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25672 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactttgtgcacgacgacagcattccgtggcgttatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25673 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaaggttcagagactttatggtttggctactgttgctaa

SEQ ID NO: 25674 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaaagttcagagactttatggtttggctactgttgctaa

SEQ ID NO: 25675 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaagattcagagactttatggtttggctactgttgctaa

SEQ ID NO: 25676 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttggcaagcaggcgctggagccggtccagcggctgttgccggtgctgtgccaggcccacggcgtgaccccggagcaggtggtggccatcgccagccacgatggcggcaagcaggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25677 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttggcaagcaggcgctggagacggtccagcggctgttgccggtgctgggccaggcccacggcttgaccccggagcaggtggtggccatcgccagccacgatggcggcaagcaggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25678 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttggcaagcaggcgctggagacggtccagcggctggtgccggtgctgtgccaggcccacggcttgaccccggagcaggtggtggccatcgccagccacgatggcggcaagcaggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25679 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttggcaagcaggcgcgggggacggtccagcggctgttgccggtgctgtgccaggcccacggcttgaccccggagcaggtggtggccatcgccagccacgacggcggcaagcaggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25680 - DNA, 406 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgctggtgctgtgccaggcccacggcttgaccccggagcaggtggctgatgcaccagttatgttggaccgaatgttgcgtctcttggcttgttacaatatcctcacttgttcagttcgtactcaacaagatggaaagattcagagactttatggtttggctactgttgcta

SEQ ID NO: 25681 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaagattcagagactttatggtttggctactgttgctaa

SEQ ID NO: 25682 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaaggttcagagactttatggtttggctactgttgctaa

SEQ ID NO: 25683 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaaagttcagagactttatggtttggctactgttgctaa

SEQ ID NO: 25684 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 25685 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25686 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25687 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25688 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgccaccaatattgctggcgatggcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25689 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgccaccaatattgctggcgatggcggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25690 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25691 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25692 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25693 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25694 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25695 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttggctaa

SEQ ID NO: 25696 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 25697 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttccccgcgcgttggccgattcattaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25698 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaagattcagagactttatggtttggctactgttgctaa

SEQ ID NO: 25699 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaaagttcagagactttatggtttggctactgttgctaa

SEQ ID NO: 25700 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaaggttcagagactttatggtttggctactgttgctaa

SEQ ID NO: 25701 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttatgcaccagttatgttggaccgaatgttgcgtctcttggcttgttacaatatcctcacttgttcagttcgtactcaacaagatggaaagattcagagactttatggtttggctactgttgctaa

SEQ ID NO: 25702 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25703 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25704 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25705 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttagcgcctcaaatagatcctgttcaggaaccggatcaaagagttcctccgccgctggacctaccaaggcaacgctatgttctcttgcttttgtcagcaagattgcgtctcttggcttgttacaatatcctcacttgttcagttcgtactcaacaagatggaaagattcagagactttatggtttggctactgttgctaa

SEQ ID NO: 25706 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttagcgcctcaaatagatcctgttcaggacccggatcaaagagttcctccgccgctggacctaccaaggcaacgctatgttctcttgcttttgtcagcaagattgcgtctcttggcttgttacaatatcctcacttgttcagttcgtactcaacaagatggaaagattcagagactttatggtttggctactgttgctaa

SEQ ID NO: 25707 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttagcgcctcaaatagaccctgttcaggaaccggatcaaagagttcctccgccgctggacctaccaaggcaacgctatgttctcttgcttttgtcagcaagattgcgtctcttggcttgttacaatatcctcacttgttcagttcgtactcaacaagatggaaaggttcagagactttatggtttggctactgttgctaa

SEQ ID NO: 25708 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaggttcagagactttatggtttggctactgttgctaa

SEQ ID NO: 25709 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaagttcagagactttatggtttggctactgttgctaa

SEQ ID NO: 25710 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaagattcagagactttatggtttggctactgttgctaa

SEQ ID NO: 25711 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttctgttcgtactcaacaagatggaaaggttcagagactttatggtttggctactgttgctaa

SEQ ID NO: 25712 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaggttcagagcctttatggtttggctattgttgctaa

SEQ ID NO: 25713 - DNA, 468 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgtaaaaatatcccatggaagtcgtagttatgttgtttacctatccaatgaattgtcacatgctaaggtttaatgcaaatcggctacattatggccttcctagtaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25714 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 25715 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaagattcagagactttatggtttggctactgttgctaa

SEQ ID NO: 25716 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25717 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggcacagcaccggcaacagccgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25718 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggcacagcaccggcaacagccgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25719 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggcacagcaccggcaacagccgctggaccctgatgcaccagttatgttggaccgaatgttgcgtctcttggcttgttacaatatcctcacttgttcagttcgtactcaacaagatggaaaagttcagagactttatggtttggctagtgttgctaa

SEQ ID NO: 25720 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggatcgaatgttgcgtctcttggcttgttacaatatcctcacttgttcagttcgtactcaacaagatggaaaagttcagagactttatggtttggctactgttgctaa

SEQ ID NO: 25721 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaagattcagagactttatggtttggctactgttgctaa

SEQ ID NO: 25722 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaaggttcagagactttatggtttggctactgttgctaa

SEQ ID NO: 25723 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttctgttcgtactcaacaagatggaaaggttcagagactttatggtttggctactgttgctaa

SEQ ID NO: 25724 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggaccgaatgttcgtctcttggcttgttacaatatcctcacttgttcagttcgtactcaacaagatggaaaggttcagagactttatggtttggctactgttgctaa

SEQ ID NO: 25725 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcgctggagacggtccaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25726 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcccacggcttgaccccggagcgggtggtggccatcgccagcaatattggtggcaagcaggcgctggagacggtgcaggcgctgttgccggtgctgtgccaggcccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25727 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcccacggcttgaccccggagcaggtggtggccatcgccagcaatattggtggcaagcaggcgctggagacggtgcaggcgctgttgccggtgctgtgccaggcccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25728 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcccacggcttgaccccggagcaggtggtggccatcgccagcaatattggtggcaagcaggcgctggagacggtgcaggcgctgttgccggtgctgtgccaggcccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25729 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaagattcagagactttatggtttggctactgttgctaa

SEQ ID NO: 25730 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttctgttcgtactcaacaagatggaaaggttcagagactttatggtttggctactgttgctaa

SEQ ID NO: 25731 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 25732 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 25733 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 25734 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttttgttggaccgaatgttgcgtctcttggcttgttacaatatcctcacttgttcagttcgtactcaacaagatggaaaggttcagagactttatggtttggctactgttgctaa

SEQ ID NO: 25735 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 25736 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttgtaccgaatattgcgtctcttggcttgttacaatatcctcacttgttcagttcgtactcaacaagatggaaacgttcagagactttatggtttggctactgttactaa

SEQ ID NO: 25737 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggtccgaatgttgcgtctcttggcttgatacaatatcttctcttgttcagtgcgtactcatcaagattgaaagtttcacacccctgatgttctggcgactgttgctaa

SEQ ID NO: 25738 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttgggccgaatgttgcgtctcttggcttgttacaatatcctcacttgttcagttcgtactcaacaagatggaaagattcagagactttatggtttggctactgttgctaa

SEQ ID NO: 25739 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 25740 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25741 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25742 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25743 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25744 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 25745 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 25746 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtcacttggcttgttacaatatcctcacttgttcagttcgtactcaacaagatggaaagattcagagactttatggtttggcgactgttgctaa

SEQ ID NO: 25747 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgagtctcttggcttgttacaatatcctcacttgttcagttcgtactcaacaagatggaaagattcagagactttatggtttggctactgttgctaa

SEQ ID NO: 25748 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 25749 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatgtaaagattcagagactttatggtttggctactgttgctaa

SEQ ID NO: 25750 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatgggttggctactgttgctaa

SEQ ID NO: 25751 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgttaa

SEQ ID NO: 25752 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaagattcagagactttatggtttggctactgttgctaa

SEQ ID NO: 25753 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 25754 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 25755 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggacagaatgttgcgtctcttggcttgttacaatatcctcacttgttcagttcgtactcaacaagatggaaagattcagagactttatggtttggctactgttgctaa

SEQ ID NO: 25756 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctacgttgctaa

SEQ ID NO: 25757 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 25758 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctagttgctaa

SEQ ID NO: 25759 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 25760 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgcta

SEQ ID NO: 25761 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggagaggttcagagactttatggtttggctactgttgctaa

SEQ ID NO: 25762 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggctggttacaatatcctcacttgttcagttcgtactcaacaagatggaaagattcagagactttatggtttggctactgttgcgaa

SEQ ID NO: 25763 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 25764 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 25765 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgtgtctcttggcttgttacaatatcctcacttgttcagttcgtactcaacaagatggaaagattcagagactttatggtttggctactgttgctaa

SEQ ID NO: 25766 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcgcttgttcagttcgtactcaacaagatggaaagattcagagactttatggtttggctactgttgctaa

SEQ ID NO: 25767 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 25768 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagatgcagagactttatggtttgctctgttgctaa

SEQ ID NO: 25769 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctga

SEQ ID NO: 25770 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 25771 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggagagattcagagactttatggtttggctactgttgctaa

SEQ ID NO: 25772 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25773 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggatactgttgctaa

SEQ ID NO: 25774 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttaa

SEQ ID NO: 25775 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25776 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgtggctcctcggggctggttacagtgtcttcgcgtgttcagtacgtacgctacattacggataggtacagagtctgtatggtatagcgacttttgttaa

SEQ ID NO: 25777 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacgagatggaaagattcagagactttatggtttggctactgttgctaa

SEQ ID NO: 25778 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgtccgtactcaacaagatggaaaggttcagagactttatggtttggctactgttgctaa

SEQ ID NO: 25779 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 25780 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaacgaatgttgcgtctcttggcttgttacaatatcctcacttgttcagttcgtactcaacaagatggaaagattcagagactttatggtttggctactgttgctaa

SEQ ID NO: 25781 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctccctttttcagttcgtactcaacaagatggaaatgttcagagactttatggtttggctactgttgctaa

SEQ ID NO: 25782 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 25783 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatagcctcacttgttcagttcgtactcaacaagatggaaaggttcagagactttatggttggctactgttgctaa

SEQ ID NO: 25784 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcccttgttcagttcgtacccaacaagatggaaaggttcagagactttatggtttggctactgttgctaa

SEQ ID NO: 25785 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttgccttgttacaatatcctcacttgttcagttcgtactcaacaagatggaaagattcagagactttatggtttggctactgttgctaa

SEQ ID NO: 25786 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgggctaa

SEQ ID NO: 25787 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 25788 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagagtcagagactttatggtttggctactgttaa

SEQ ID NO: 25789 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcagaaagatggaaagattcagagactttatggtttggctactgttgctaa

SEQ ID NO: 25790 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagggactttatggtttggctactgttgctaa

SEQ ID NO: 25791 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 25792 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 25793 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttgacttgttacaatatcctcacttgttcagttcgtactcaacaagatggaaagattcagagactttatggtttggctactgttgctaa

SEQ ID NO: 25794 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttagcttgttacaatatcctcacttgttctgttcgtactcaacaagatggaaagattcagagactttatggtttggctactgttgcgaa

SEQ ID NO: 25795 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggacttaatgtggcgtctcttggcttgttaaaataacctccttttttcagttcgtactaatcaagattgaaatattcagagactttatgattttgggactggtaataa

SEQ ID NO: 25796 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgtggcgtctcttggcttgttacaatagcctcgcttgttcaggtcgtactcaacaagatgaaaagattcagatactttatggattggctacggatgctaa

SEQ ID NO: 25797 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtcttttggcttgttacaatatcctcacttgttcagttcgtactcaacaagatggaaagattcagagactttatggtttggctactgttgctaa

SEQ ID NO: 25798 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 25799 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctatgttgctaa

SEQ ID NO: 25800 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagaggctttatggtttggctactgttgctaa

SEQ ID NO: 25801 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcatactcaacaagatggaaaggttcagagactttatggtttggctactgttgctaa

SEQ ID NO: 25802 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaacgttgcgtctcttggcttgttacaatatcctcacttgttcagttcgtactcaacaagatggaaaagttcagagactttatggtttggctactgttgctaa

SEQ ID NO: 25803 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctaaa

SEQ ID NO: 25804 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 25805 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 25806 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcatggcttgttacaatatcctcacttgttcagttcgtactcaacaagatggaaagattcagagactttatggtttggctactgttgctaa

SEQ ID NO: 25807 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctatgttgctaa

SEQ ID NO: 25808 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 25809 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactctatggtttggctactgttgctaa

SEQ ID NO: 25810 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 25811 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 25812 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatcgtttggctactgttgctaa

SEQ ID NO: 25813 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcgtgttacaatatcctcacttgttcagttcgtactcaacaagatggaaagattcagagactttatggtttggctactgttgctaa

SEQ ID NO: 25814 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcatagactttatggtttggctactgttgctaa

SEQ ID NO: 25815 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctag

SEQ ID NO: 25816 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 25817 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 25818 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 25819 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgcaa

SEQ ID NO: 25820 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgcctcttggcttgttacaatatcctcacttgttcagttcgtactcaacaagatggaaagattcagagactttatggtttggctactgttgctaa

SEQ ID NO: 25821 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctacttgttgctaa

SEQ ID NO: 25822 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggatcgaatgttgcgtctcttggcttgttacaatatcctcacttgttctgttcgtactcaacaagatggaaaggttcagagactttatggtttggctactgttgctaa

SEQ ID NO: 25823 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtacccaacaagatggaaagattcagagactttatggtttggctactgttgctaa

SEQ ID NO: 25824 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggcttactgttgctaa

SEQ ID NO: 25825 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttgaaccgaatattgcgtctcttggcttgttacaatatcctcacttgttcagttcgtactcaacaagatggaaaggttcagagactttaaggtttggctactgttgctaa

SEQ ID NO: 25826 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatattggaccgaatgttgcgtctcttggcttgttacaatatcctcacttgttcagttcgtactcaacaagatggaaaggttcagagactttatggtttggcgactgttgctaa

SEQ ID NO: 25827 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 25828 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 25829 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 25830 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttctgttcgtactcaacaagatgggaaggttcagagactttatggtttggctactgttgctaa

SEQ ID NO: 25831 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25832 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagctatgttggaccgaatgttgcgtctcttggcttgttacaatatcctcacttgttcagttcgtactcaacaagatggaaaggttcagagactttatggtttggctactgttgctaa

SEQ ID NO: 25833 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgaaccagttatgttggaccgaatgttgcgtctcttggcttgttacaatatcctcacttgttcagttcgtactcaacaagatggaaaggttcagagactttatggtttggctactgttgctaa

SEQ ID NO: 25834 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgaggaagcggaagagcgcccaatacgcaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25835 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgaggaagcggaagagcgcccaatacgcaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25836 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgttggtcggtgaacgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25837 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 25838 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25839 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25840 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25841 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25842 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25843 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25844 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25845 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgaccttaggcgacttttgaacgcgcaataatggtttctgaccgctgcgccttatccggtaactatcgtcttaatgcctcgacttcgctgctacccaaggttgccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 25846 - DNA, 421 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgaccccccagcaggtggtggccatcgccagcaatggcggtggcaagcaggcgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25847 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25848 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25849 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25850 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25851 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagactttatggtttggctactgtttctaa

SEQ ID NO: 25852 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25853 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25854 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 25855 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25856 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttattgtttggctactggtgctaa

SEQ ID NO: 25857 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 25858 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 25859 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttctgttcgtactcaacaagatggaaaggttcagagacttgatggtttggctactgttgctaa

SEQ ID NO: 25860 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25861 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatgggttggctactgttgctaa

SEQ ID NO: 25862 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttactatatcctcacttgttcagttcgtactcaacaagatggaaagattcagagactttatggtttggctactgttgctaa

SEQ ID NO: 25863 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 25864 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcgcttgttcagttcgtactcaacaagatggaaaggttcagagactgtatggtttggctactgttactaa

SEQ ID NO: 25865 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgtttgctaa

SEQ ID NO: 25866 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 25867 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25868 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25869 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctccaggggaagccgaagtttccaaaaggtcgttgatcaaagctcgccgcgttgtttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25870 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcgtaaccgtatcgatatgctctcaaccggcattaaaagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25871 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25872 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25873 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25874 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 25875 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcattgccaaatgtttgaacgatcgcgccctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25876 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25877 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaaggttcagagactttatggtttggctactgttgctaa

SEQ ID NO: 25878 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttctgttcgtactcaacaagatggaaaggttcagagactttatggtttggctactgttgctaa

SEQ ID NO: 25879 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaaagttcagagactttatggtttggctactgttgctaa

SEQ ID NO: 25880 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaagattcagagactttatggtttggctactgttgctaa

SEQ ID NO: 25881 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaaggttcggagactttatggtttggctactgttgctaa

SEQ ID NO: 25882 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaagattcagagactttatggtttggctactgttgctaa

SEQ ID NO: 25883 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaaagttcagagactttatggtttggctactgttgctaa

SEQ ID NO: 25884 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaaggttcagagactttatggtttggctactgttgctaa

SEQ ID NO: 25885 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaaggttcagagactttatggtttggctactgttgctaa

SEQ ID NO: 25886 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaaagttcagagactttatggtttggctactgttgctaa

SEQ ID NO: 25887 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaagattcagagactttatggtttggctactgttgctaa

SEQ ID NO: 25888 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttgcatctcttggcttgttacaatatcctcacttgttcagttcgtactcaacaagatggaaaggttcagagactttatggtttggctactgttgctaa

SEQ ID NO: 25889 - DNA, 439 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgccggtgctgtgccaggcccacggcttgaccccggagcaggtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25890 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttgggccgaatgttgtgtctcttggcttgttacaatatcctcacttgttcagttcgtactcaacaagatggaaaggttcagagactttatggtttggctactgttgctaa

SEQ ID NO: 25891 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25892 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 25893 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25894 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgtgctaa

SEQ ID NO: 25895 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 25896 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatcaacttgaccccggagcaggtggtggccatcgccagccacgatggcggcaagcaggcgctggacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25897 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25898 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25899 - DNA, 423 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 25900 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25901 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaggccgacgaaatgcagaggtacgtggaggagaaccagaccaggaacaagcacatcaaccccctgatgcaccagttatgttggaccgaatgttgcgtctcttggattgttacaatatcctcacttgttcagttcgtactcaacaagatggatagattcagagactttatggtttggctactgttgctaa

SEQ ID NO: 25902 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaggccgacgaaatgcagaggtacgtggaggagaaccagaccaggaacaagcacatcatccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25903 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagctggaccgtctccagcgcctgcttgccgccatcgtggctggcgatggccaccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25904 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagctggaccgtctccagcgcctgcttgccgccatcgtggctggcgatggccaccaccctgatgcaccagttatgttggaccgaatgttgcgtctcttggcttgttacaatatcctcacttgttcagttcgtactcaacaagatggaaaggttcagagactttatggtttggctactgtt

SEQ ID NO: 25905 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagctggaccgtctccagcgcctgattgccgccatcgtggctggcgatggccaccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25906 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagctggaccgtctccagcgcctgcttgccgccatcgtggctggcgatggccaccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25907 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagctggaccgtctccagcccctgcttgccgccatcgtggctggcgatggccaccaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25908 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagctggaccctctccagccccttcttgccagtatcgttgctgtcgaaggacaccaccctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 25909 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcgcctgcttgccgccatcgtggctggcgacggcccccacctgccccggggtcaagccgtgggcctggcacagcaccggcaccagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25910 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcgcctgcttgccgccaccgtggctggcgacggccaccaccggctccggggtcaagccgggggcctggcacagaaccggcaacagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25911 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccggtgctgtgccaggcccacggcttgcccccggagcaggtggtggccatcgcctggcacagcaccggcaacagccgctggatgcaccagttatgttggaccgaatgttgcgtctcttggcttgttacaatatcctcacttgttcagttcgtactcaacaagatggaaagattcagagactttatggtttggctactgttgctaa

SEQ ID NO: 25912 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccggtgctgtgccaggcccacggcttgaccccggagcaggtggtggccatcgcctggcacagcaccggcaacagccgctggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25913 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccggtgctgtgccaggcccacggcttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25914 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccggtgctgtgccaggcccacggcttgaccccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25915 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccggtgctgtgccaggcccacggcttgaccccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25916 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccacgatggcggcaagcaggcgctggagacggtccagcggctgttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25917 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccacgatggcggcaagcaggcgctggagacggtccagcggctgttctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25918 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccacgatggcggcaagcaggcgctggagacggtccagcggctgttctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25919 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaccagttattttggaccgaatgttgcgtctcttggcttgttacaatatcctcacttgttcagttcgtactcaacaagatggaaagattcagagactttatggtttggctactgttgctaa

SEQ ID NO: 25920 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaagattcagagactttatggtttggctactgttgctaa

SEQ ID NO: 25921 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaaggttcagagactttatggtttggctactgttgctaa

SEQ ID NO: 25922 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttaaaatatcctcacttattcagttcgtactcaacaagatggaaagattcagagactttatggtttggctactgttgctaa

SEQ ID NO: 25923 - DNA, 445 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaatggcggtggcagccaggcgctggagagtgcctgcatggccccctgcactgatgggtgccccgctcacattgaccccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25924 - DNA, 445 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25925 - DNA, 445 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25926 - DNA, 445 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 25927 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaaatatttcttgtcaaaaatgctccactgacgttccataaattcccctcggtatccaattagagtctcatattcactctcaatccaaataatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25928 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaaatatttcttgtcaaaaatgctccactgacgttccataaattcccctcggtatccaattagagtctcatattcactctcaatccaaataatgatgcaccagttatgttggaccgaatgttgcgtctcttggcttgttacaatatcctaacttgttcagttcgtactcaacaagatggaaagattcagagactttatggtttggctactgttgctaa

SEQ ID NO: 25929 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacttgaccccggggcgggtggtggccatcgccagccacgatggcggcaacagccgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25930 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaacagccgctggactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25931 - DNA, 423 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaagcaggcgctggactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25932 - DNA, 423 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25933 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaacagccgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25934 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaacagccgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25935 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccccctgctccggggtcaagccgtgggcctggcacagcaccggcaacaggcgctggaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 25936 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacagcaccggcaacaggcgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25937 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacagcaccggcaacaggcgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25938 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacagcaccggcaacagccgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25939 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccacctgctccggggtcaagcggtgggcctggcacagcaccggcaacagccgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25940 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacagcaccggcaacaggcgctggaccctgatgcaccagttatgttggaccgaatgttgcgtctcttggcttgttacaatatcctcacttgttcagttcgtactcaacaagctggaaagattcagagactttatggtttggctactgttctaa

SEQ ID NO: 25941 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25942 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25943 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25944 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcggctcttggcttgttacaatatcctcacttgttcagttcgtactcaacaagatggaaagattcagagactttatggtttggctactgttgctaa

SEQ ID NO: 25945 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcactttttcagttcgtactcaacaagatggaaaggttcagagactttatggtttggctactgttgctaa

SEQ ID NO: 25946 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggtgcagagactttatggtttggctactgttgctaa

SEQ ID NO: 25947 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25948 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25949 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctag

SEQ ID NO: 25950 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25951 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25952 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccggcaacagccgctggaccgtctccagcaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25953 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcttctcttggcttgttacaatatcctcacttgttcagttcgtactcaacaagatggaaaggttcagagactttatggtttggctactgttgctaa

SEQ ID NO: 25954 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaaggttcagagactttatggtttggctactgttgctaa

SEQ ID NO: 25955 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaagattcagagactttatggtttggctactgttgctaa

SEQ ID NO: 25956 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaaagttcagagactttatggtttggctactgttgctaa

SEQ ID NO: 25957 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaaggttcagagactctatggtttggctactgttgctaa

SEQ ID NO: 25958 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25959 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25960 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 25961 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 25962 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 25963 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaggttcagagactttatggtttggctactgttgctaa

SEQ ID NO: 25964 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 25965 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 25966 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgtttgacctaatgttgcgtctcttggcttgttacaatatcctcacttgttcagttcgtactcaacaagatggaaaggttcagagactttatggtttggctactgttgctaa

SEQ ID NO: 25967 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtcgcttggcttgttacaatatcctctcttgttcagttcgtactcaacaagatggaaaggttcagagactttatggtttggctaatgtggctaa

SEQ ID NO: 25968 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25969 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcaaagactttatggtttggctactgttgctaa

SEQ ID NO: 25970 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 25971 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 25972 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagctatgttggaccgaatgttgcgtctcttggcttgttacaatatcctcacttgttcagttcgtactcaacaagatggaaagattcagagactttatggtttggctactgttgctaa

SEQ ID NO: 25973 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatggaaagattcagagactttatggtttggctactgttgctaa

SEQ ID NO: 25974 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatggaaaggttcagagactttatggtttggctactgttgctaa

SEQ ID NO: 25975 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatggaaaagttcagagactttatggtttggctactgttgctaa

SEQ ID NO: 25976 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccagttatattggaccgaatgttgcgtctcttggcttgttacaatatcctcacttgttcagttcgtactcaacaagatggaaaggttcagagactttatggtttggctactgttgctaa

SEQ ID NO: 25977 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacatacgtcagaaaccattaatgcgcgttcaaaagtcgcctaaggtcactatcagctagcaaatatttcttgtcaaaaatgctccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25978 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacatacgtcagaaaccattattgcgcgttcaaaagtcgcctaaggtcactatcagctagcaaatatttcttgtcaaaaatgctccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 25979 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacatacgtcagaaaccattattgcgcgttcaaaagtcgcctaaggtcactatcagctagcaaatatttcttgtcaaaaatgctccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25980 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacatacgtcagaaaccataagtgcgcgttcaaaaggcgcctaaggtcactatcagctagcaaatatttcttgtcaaaaatgctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25981 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaaggttcagagactttatggtttggctactttgctaa

SEQ ID NO: 25982 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaaggttcagagactttatggtttggctactgttgctaa

SEQ ID NO: 25983 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaagattcagagactttatggtttggctactgttgctaa

SEQ ID NO: 25984 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttgggccgaatgttgcgtctcttggcttgttacaatatcctcacttgttcagttcgtactcaacaagatggaaagattcagagactttatggtttggctactgttgctaa

SEQ ID NO: 25985 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 25986 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25987 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaagtttagagactttatggtttggctactgttgctaa

SEQ ID NO: 25988 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtcgcttggcttgttacaatatcctcacttgttcagttcgtactcaacaagatggaaagattcagagactttatggtttggctactgttgctaa

SEQ ID NO: 25989 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactggtgctaa

SEQ ID NO: 25990 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 25991 - DNA, 436 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgaatcggccaacgcgcggggagaggcggtttgcgtattgggcgctcttccgcttcctcgctcactgactcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25992 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 25993 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25994 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 25995 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 25996 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 25997 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 25998 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 25999 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26000 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 26001 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26002 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26003 - DNA, 452 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaactggaaagcgggcagtgagcgcaacgcaattaatacgcgtaccgctagccaggaagagtttgtagaaacgcaaaaaggccatccgtacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26004 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacgtaattcaacagaaattatatgataatcatcgcaagaccggcaacaggattcaatcttaagaaactttatttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26005 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacgtaattcaacagaaattatatgataatcatcgcaagaccggcaacaggattcaatcttaagaaactttatttgatgcaccaggtatgttggaccgaatgttgcgtctcttggcttgttacaatatcctcacttgttcagttcgtactcaacaagatggaaaggttcagagactttatggtttggctactgttgctaa

SEQ ID NO: 26006 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacgtaattcaacagaaattatatgataatcatcgcaagaccggcaacaggattcaatcttaagaaactttatttggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 26007 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacgtaattcaacagaaattatatgataatcatcgcaagaccggcaacaggattcaatcttaagaaactttatttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26008 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaagattcagagactttatggtttggctactgtttgctaa

SEQ ID NO: 26009 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26010 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgaaccagttatgttggaccgaatgttgcgtctcttggcttgttacaatatcctcacttgttcagttcgtactcaacaagatggaaaggttcagagactttatggtttggctactgttgctaa

SEQ ID NO: 26011 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 26012 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26013 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgtgggcctggcacagccccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26014 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgtgggcctggcacagcaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26015 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgtgggcctggcccagcaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26016 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgtgggccgggcacagcaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26017 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgggggcctggcacagcaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26018 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacgccagcaacgcggcctttttacggttcctggccatgcaccagttatgttggaccgaatgttgcgtctcttggcttgttacaatatcctcacttgttcagttcgtactcaacaagatggaaagattcagagactttatggtttggctactgttgctaa

SEQ ID NO: 26019 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacgccagcaacgcggcctttttacggttcctggccatgcaccagttatgttggaccgaatgttgcgtctcttggcttgttacaatatcctcccttgttctgttcgtactcaacaagatggaaagattcagagactttatggtttggctactgttgctaa

SEQ ID NO: 26020 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26021 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 26022 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 26023 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26024 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttctgttcgtactcaacaagatggaaaggttcagagactttatggtttggctactgttgcta

SEQ ID NO: 26025 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26026 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacatgatggaaaggttcagagactttatggtttggctactgttgctaa

SEQ ID NO: 26027 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagtcatgttggaccaaatgttgcgtctcttggcttgttacaatatcctcacttgttctgttcgtactcaacaagatggaaaggttcagagactttatggtttggctactgttgctaa

SEQ ID NO: 26028 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26029 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccgtctccagcgcctgcttgccgccatcggggctggcgagggccaccacctgctccggggtcaagccgtgggcctggcacagcaccggcaacagccgctggaccgacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26030 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccgtctccagcgcctgcgtgccgccatcgtggctggcgagggccaccacctgctccggggtcaagccgtgggcctggcacagcaccggcaacagccgctggaccgacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26031 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccgtctccagcgcctgcgcgccgccatggtgccggccgagggccaccacctgctccggggtcaagccgtgggcctggcacagcaccggcaacagccgctggaccgacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26032 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggtgctgtgccaggcccacggcttgaccccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26033 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggtgctgtgccaggcccacggcttgaccccggagcaggtggctgatgcaccagttatgttggaccgaatgttgcgtctcttggcttgttacaatatcatcacttgttcagttcgtactcaacaagatggaaagattcagagactttatggtttggctactgttgctaa

SEQ ID NO: 26034 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggtgctgtgccaggcccacggcttgaccccggagcaggtggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26035 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcggatttgtcctactcaggagagcgttcaccgacaaacaacagataaaacgaaaggcccagtctctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26036 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcggatttgtcctactcaggagagcgttcaccgacaaacaacagataaaacgaaaggcccagtctctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26037 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcggatttgtcctactccggagagcgttcaccgacaaacaacagataaaacgaaaggctcagtctctgatgcaccagttatgttggaccgaatgttgcgtctcttggcttgttacattatcctcacttgttcagttcgtactcaacaagatggaaaggttcagagactttatggtttggctactgttgctaa

SEQ ID NO: 26038 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcggatttgtcctactcaggagagcgttcaccgacaaacaacagataaaacgaaaggcccagtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26039 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcggatttgtcctactcaggagagcgttcaccgacaaacaacagataaaacgaaaggctcagtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26040 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcggatttgtcctactcaggagagcgttcaccgacaaacaacagataaaacgaaaggctcagtctctgatgcaccagttatattggaccgaatgttgcgtctcttggcttgttacaatatcctcacttgttcagttcgtactcaacaagatggaaaggttcagagactttatggtttggctactgttgctaa

SEQ ID NO: 26041 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26042 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26043 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26044 - DNA, 454 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccgccatcgtggcgggcgatgccccccacctgctccggggtcaagccgtgggcctggcacagcaccggcaacagccgctggaccgtctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26045 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccgccagcgtggctggcgagggccaccccctgctccggggtcaagccgtgggcctggcacagcaccggcaacagccgctggaccgtctccctgatgcaccagttatgttggaccgaatgttgcgtctcttggcttgttacaatatcctcacttgttcagttcgtactcaacaagatggaaaggttcagagactttatggtttggcttactgttgctaa

SEQ ID NO: 26046 - DNA, 416 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccgagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26047 - DNA, 464 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccgactggaaagcgggcagtgagcgcaacgcaattaatacgcgtaccgctagccaggaagagtttgtagaaacgcaaaaaggccatccgtcaggatggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26048 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgttgggccgaatgttgcgtctcttggcttgttgcaatatcctcacttgttcagttcgtactcaacaagatggaaaggttcagagactttatggtttggctactgttgctaa

SEQ ID NO: 26049 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgttggaccgaatgttgcgtctcttggcttgttacaatatcctcacttgttcagttcgtactcaacaagatggaaaggttcagagactttatggtttggctactgttgctaa

SEQ ID NO: 26050 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgttggaccgaatgttgcgtctcttggcttgttacaatatcctcacttgttcagttcgtactcaacaagatggaaagattcagagactttatggtttggctactgttgctaa

SEQ ID NO: 26051 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgttggaccgaatgttgcgtctcttggcctgttacaatatcctcacttgttcagttcgtactcaacaagatggaaagattcagagactttatggtttggctactgttgctaa

SEQ ID NO: 26052 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctccgggccgttgcttcacaacgttcaaatccgctcccggcggatttgtcctactcaggagagcgttcaccgacaaacaacagataaaacgaaaggcccagtcttctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26053 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26054 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26055 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26056 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccggagcaggtggtggccatcgccagccacgatgggggcaagcaggcgctggagacggtccagcggctgttgccggtgctgtgccaggcccacggcttgaccccccagctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26057 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccggagcaggtggtggccatcgccagccaggatggcggcaagcaggcgctggagacggtccagcggctgttgccggtgctgtgccaggcccacggcttgaccccccagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26058 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccggagcaggtggtggccatcgccagccacgatggcggcaagcaggcgctggagacggtccagcggctgttgccggtgctgtgccaggcccacggcttgaccccccagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26059 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccggagcaggtggtggccatcgccagccacgatggcggcaagcaggcgctggagacggtccagcggctgttgccggtgctgtgccaggcccacggcttgaccccccagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26060 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccggagcaggtgggggccttcgccagccacgctggcggcaagcaggcgctggagacggtccagcggctgttgccggtgctgtgccaggcccacggcttgacccccccgctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 26061 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26062 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccccagcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26063 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccccagcatgcaccagttatgttggaccgaatgttgcgtctcttggcttgttacaatatcctcacttgttcagttcgtactcaacaagatggaaagattcagagactttatggtttggctactgttgctaa

SEQ ID NO: 26064 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccccagcgcctgcttgccaccgccacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26065 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggactgaatgttgcgtctcttggcttgttacaatatcctcacttgttcagttcgtactcaacaagatggaaagattcagagactttatggtttggctactgttgctaa

SEQ ID NO: 26066 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttgactactgttgctaa

SEQ ID NO: 26067 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 26068 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctacttttgctaa

SEQ ID NO: 26069 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttggctactgttctaa

SEQ ID NO: 26070 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 26071 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcttcacttgttcagttcgtactcaacaagatggaaagattcagagactttatggtttggctactgttgctaa

SEQ ID NO: 26072 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26073 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaccagccgctggagactgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 26074 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26075 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaagcaggcgctggagactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26076 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaagcaggcgctggagacggtccagcggctgttgccggtgctgtgccaggcccacggcttgaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26077 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaagcaggcgctggagactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26078 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 26079 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26080 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26081 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaatggttcagagactttatggtttggctactgttgctaa

SEQ ID NO: 26082 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacctgctgaggggtcaagccgtgggcctggcacagcaccggcaacagccgctggatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26083 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaccagttatgttggaccgaatgttgcgtctcttggcttgttacaatatcctcacttgttcagttcgtactcaacaagatggaaaagttcagagactttatggtttggctactgttgctaa

SEQ ID NO: 26084 - DNA, 460 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaatgaaaaggggcagccgccacccatgaaatatataggacccctataggactcatgtgcatattaaccgtttgccacccatgctttcatatccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26085 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26086 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26087 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26088 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 26089 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacaacaacaaaccaacccttagttgcacacccttgtgtttttctttgtttgttgtttgttttattttcttagtccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26090 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26091 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaatgcaccagttatgttggaccgaatgttgtgtctcttggcttgttacaatatcctcacttgttcagttcgtactcaacaagatggaaagattcagagactttatggtttggctactgttgctaa

SEQ ID NO: 26092 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26093 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaagcaacaatgctctccagcgccggcctgccgccgccattgctggcgatggccaccacctgctgaggggtcaagccgtgggcctggcacagcaccggcaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26094 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaagcaacaatgctctccagcgccggcctgccgccgccattgctggcgatggccaccacctgctgaggggtcaagccgtgggcctggcacagcaccggcaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26095 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaagcaacaatgctccccagcgccggcctgccgccgccattgctggcgatggccaccacctgctgaggggtcaagccgtgggcctggcacagcaccggcaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26096 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26097 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26098 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaagattcagagactttatggtttggctactgttgctaa

SEQ ID NO: 26099 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttctaa

SEQ ID NO: 26100 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttgctaa

SEQ ID NO: 26101 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaagttcagagactttatggtttggctactgttgctaa

SEQ ID NO: 26102 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcctggcttgttacaatatcctcacttgttcagttcgtactcaacaagatggaaaggttcagagactttatggtttggctactgttgctaa

SEQ ID NO: 26103 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgcactcaacaagatggaaaggttcagagactttatggtttggctactgttgctaa

SEQ ID NO: 26104 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaaaaagatggaaaggttcagagactttatggtttggctactgttgctaa

SEQ ID NO: 26105 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttatgttggaccgaatgttgcgtctcttggcttgttacaatatcctcacttgttcagttcgtactcaacaagatggaaaggttcagagactttatggtttggctactgttgctaa

SEQ ID NO: 26106 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttatgttggaccgaatgttgcgtctcttggcttgttacaatatcctcacttgttcagttcgtactcaacaagatggaaaagttcagagactttatggtttggctactgttgctaa

SEQ ID NO: 26107 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgtgatgcaccagttatattggaccgaatgttgcgtctcttggcttgttacaatatcctcacttgttcagttcgtactcaacaagatggaaaggttcagagactttatggtttggctactgttgctaa

SEQ ID NO: 26108 - DNA, 377 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgtcaagcaggcgctggagaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26109 - DNA, 459 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgtcaaaattaataaatgcatgtgattgagtaaaatattgatcaccaacaatttttttgaataaaatcaattaattacatccacaattgggacaataacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26110 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgtactcaacaagatggaaaggttcagagactttatggtttggctactgttgctaa

SEQ ID NO: 26111 - DNA, 377 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacggcaagcaggcgctggagaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26112 - DNA, 377 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacggcaagcaggcgctggagaatgcaccagttatgttggaccgaatgttgcgtctcttggcttgttacaatatcctcacttgttcagttcgtactcaacaagagggaaaggttcggagactgtatggtttggctactgttgctaa

SEQ ID NO: 26113 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26114 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26115 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26116 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26117 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26118 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcaattgttcagttcgtactcaacaagatggaaagattcagagactttatggtttggctactgttgctaa

SEQ ID NO: 26119 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26120 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 26121 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccaattatgttggaccgaatgttgcgtctcttggcttgttacaatatcctcacttgttcagttcgtactcaacaagatggaaagattcagagactttatggtttggctactgttgctaa

SEQ ID NO: 26122 - DNA, 427 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgagcgaggaagcggaagcgcccacaaaccccaagccgcctctccccgcgcgttggccgattcattaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26123 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26124 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggataggttcagagactttatggtttggctactgttgctaa

SEQ ID NO: 26125 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgactgatgcaccagttatgttggaccgaatgttgagtctcttggcttgttacaatatcctcacttgttcagttcgtactcaacaagatggaaaggttcagagactttatggtttggctactgttgctaa

SEQ ID NO: 26126 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26127 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26128 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26129 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagttatgtcggaccgaatgttgcgtcccttggcttgttacaatatcctcacttgttcagttcgtactcaacaagatggaaagattcagagactttatggtttggctactgttgctaa

SEQ ID NO: 26130 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26131 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgctgcaccagttatgttggaccgaatgttgcgtctcttggcttgttacaatttcctcacttgttcagttcgtactcaacaagatggaaaggttcagagactttatggtttggctactgttgctaa

SEQ ID NO: 26132 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgctccagttatgttggaccgaatgttgcgtctcttggcttgttacaatatcctcacttgttcagttcgtactcaacaagatggaaaggttcagagactttatggtttggctactgttgctaa

SEQ ID NO: 26133 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 26134 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26135 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26136 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26137 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 26138 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26139 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 26140 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtcgcttggcttgttacaatttcctcacttgttcagttcgtactcaacaagatggaaaagttcagagactttatggtttggccactgttgctaa

SEQ ID NO: 26141 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggctggttacaatatcctcacttgttcagttcgtactcaacaagatggaaagattcagagactttatggtttggctactgttgctaa

SEQ ID NO: 26142 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 26143 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 26144 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcgcttgttcagttcgtactcaacaagatggaaagattcagagactttatggtttggctactgttgctaa

SEQ ID NO: 26145 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttaaggtttggctactgttgctaa

SEQ ID NO: 26146 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 26147 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttagtactcaacaagatggaaaggttcagagactgtatggtttggctactgttgctaa

SEQ ID NO: 26148 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 26149 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttctaa

SEQ ID NO: 26150 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 26151 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgataa

SEQ ID NO: 26152 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 26153 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaggatggaaaagttcagagactttatggtttggctactgttgctaa

SEQ ID NO: 26154 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtgtggctactgttgctaa

SEQ ID NO: 26155 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 26156 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 26157 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggttggctactgttgctaa

SEQ ID NO: 26158 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 26159 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcagcaagatggaaagattcagagactttatggtttggctactgttgctaa

SEQ ID NO: 26160 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttgcaatatcctcacttgttcagttcatactcaacaagatggaaaggttcagagactttatggtttggctactgttgctaa

SEQ ID NO: 26161 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagtttgtactcaacaagatggaaaggttcagagactttatggtttggctactgttgctaa

SEQ ID NO: 26162 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 26163 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 26164 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcggagactttatggtttggctactgttgctaa

SEQ ID NO: 26165 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26166 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 26167 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgcctcttggcttgttacaatatcctcacttgttcagttcgtactcaacaagatggaaaagttcagagactttatggtttggctactgttgctaa

SEQ ID NO: 26168 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgtacaatatcctcacttgttcagttcgtactcaacaagatggaaagattcagagactttatggtttggctactgttgctaa

SEQ ID NO: 26169 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 26170 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 26171 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactctatggtttggctactgttgctaa

SEQ ID NO: 26172 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 26173 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 26174 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttcgctactgttgctaa

SEQ ID NO: 26175 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatggtgcctctcttggcttgttacaatatcctcacttgttcaggtcgtactcaacaagatggaaagattcagagactttatggtttggctactgttgctaa

SEQ ID NO: 26176 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaataccctcacttgttcagttcgtactcaacaagatggaaagattcagagactttatggtttggctactgtcgctaa

SEQ ID NO: 26177 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctctgggcttgttacaatatcctcacttgttcagttcgtactcaacaagatggaaagattcagagactttatggtttggctactgttgctaa

SEQ ID NO: 26178 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaatattcagagactttatggtttggctactgttgctaa

SEQ ID NO: 26179 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttcgctactgttgctaa

SEQ ID NO: 26180 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 26181 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 26182 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcccctcttgttcagttcgtactcaacaagatggaaagattcagagactttatggtttggctactgttgctaa

SEQ ID NO: 26183 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcatactcaacaagatggaaagattcagagactttatggtttggctactgttgctaa

SEQ ID NO: 26184 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 26185 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26186 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 26187 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgaa

SEQ ID NO: 26188 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttgaaccgaatgttgcgtctcttggcttgttacaatatcctcacttgttcagttcgtactcaacaagatggaaaggttcagagactttatggtttggctactgttgctaa
